United States Patent 10,724,096 (METHODS AND COMPOSITIONS FOR INHIBITING AND TREATING NEUROLOGICAL CONDITIONS) - sequence listing, part 131

SEQ ID NO: 2406 - DNA, 429000 bp, Homo sapiens
ctcattttcatatcaattggcagaaattatctttattagaaaaatgaaattttcctgtatttacatttttacaccatatgaccgggcacttctgttgcctcaggagttatatacatatcagtttgcacacgaatttcaatccccattccttaaaacagttgataacacattgaacaaaattaaaagacatactacaagaagacaaccatagtatatacttcctctatcatagaaaggtgttaagcaaacatataattttgtagctatgcttggaaatatttaatacacttattagcacttcctcatgcagtggattaaaacatgacagatataaactgctgcagttgatcagtgaacattaattcccaaatgaagaccattgcttagagcagacagcttgctttcagctccaccatacaagacatcaagtcagttctgatgtgggttttggattctgtttgaatgtagctgtgaatagaaaccctctgcatatggagttcaatcctagccttgttgggttaaaaatggactcagacataaacctggatagctgcttaattcaataactttcttgcaggcaatgaccagcttgtgtattatgcaacaagtcatattattaatacgtgagtgaaaaatgaatcatttatcctctttgagaaggccattatttataatttttatgatctaattcttattcaagctaccaagaaactcaccttattctttctgaacattcagcttgaaatatatatactatacataaacatatacacataaacattctggggtgatataaactatggtgaattctgccaattaattcagcaggtttatgcttttaaatttgttttggcaggggaatgaacaagattaagattcatagttaaaaacaactggtaaagaaatctttggggaccctcaggtttggaaggcatctgagccacatctaactatgtcactgctgtgtcaagcagttttctgaattttctatgaaaatgttattcttgaacttatatcttaagtaggcaattagcatcccttcccagtgaaaaatttggggaacatgaatgttaaaagttccactttcatcttttcaaattcatcaaaaatttcaaacaagatcacctggatttggctcaaattagaggcctgaatcttttgtttttaaactgaaacatttacgtaagtggtcatggccccagagcttttctacaaacttaataaactaaagatttaaaaaaatttaaaaaagattttaaaagtcaatactgttcattcacttgaattagcttgactgagaacagaaataattaaataagtcttagatggctaatgtagaaacttcgattgaattcaaaaggctatgattgtttttcatggaaaaaaaaagacaatgttttcgtatttctggatcttcgctctttgctcagttatcaatagtctttgatttgagccctttaaaacttgaaacagcaaaatgtcagatcaatgggaagcatttaaaatgccaaagacaaactcatgtttgctggagaacaattaacctcattaatttgaaaggcagctgtggtattggctatgagttatgttaatatcctattgaaggttcatcttaaatctttcctaaaggtgtgaaagagaattaactggaagaggtcatgacccagggctaatgaagaatgttctaggattgcaaaaatgcaaactcattgtttcactgacatagtaagtaagagaattatgagtgataatctcagttttgtcttcttcgtttctgcagaccgctgacactttatctgaggaagttaatctgaggaatgacttcattttaagcaatttagttctggttccctggagagttgcatgctttgaaatacaacccccagagaagaaatgctattggtcaaatcgttctttggagtgctccatttctgcatagctcaacattccaaggagaacatggtcacgcacttgtagacccaacaacaggatctccaaataacaaataataatctttctgtcttaaaaggctttttactgccagcttgaaagatgaaaacagctgagaaatttttctcatagactagcacttaacttgcattaagttagctaactctccagagaattcatggagactcccagaaagacattccttcaaatccccgctagtgtcctcatccatcaaatgggcctaatgcacccctcacctctcagtaaatataaatgccaggaaagaaatgtggcttagaccatggagaggggggaatgcaggaaaggcagtgtgtgctcaggggcatgcctgcaggatatgttaaacattaggccattctgggtacctataaagcccggtggaagcgttccagttcaacactcttcagtgggacagaataaccgtcattatcctaatgctaagtgagccgggaattatctctaagacaatttggaaaagaaaaaaaaaaaggaacagaccaagaaggaaaacaacaacaacattttaatagctggtcctcaatcattctgactaccaaagctctccatcattcatgcagaaactctatttcctattccctgtcccacctctgaaactcattccatctgcctggcaaagataaccaaacatagacatgaaataggaggaatagtcaacttgcaaataatatcacctctttgaacatgggtcacaatatttaggaggactttaatggagggtcacatggctgtgtgtgtgtgtgtgcatacccacacacatgagagcatgtactatgtatatatgtttaatggaattagccctgatgttgactgataaaaagatgagacattaggaaagagatatttaagattaggcacatgctaagtagagaaaataactccccagaaatttttttaaatgctaagtgcaagcatatgaaagggagacacaaacagtgttcaagtctcagaaggaactatgaacagaggtgagatccccagaagttctccatacacacagatcaggcaatgaggggtaagaccctaacagacttccctgtcacagaggctgatactcaagggtatatgcccaggaacctcaaaagagcacacctctctttctgacttctattctgacctccctggaggagaccaggcactttgaaaatatgtctaacgttagggatttactagctaattctagttgctgacgaggttgagaaaaacctgagcctcagtttccttatctgtaaaatgggagcaatcatatttatatcttaaggttgttttgaggatcacattctaggatatgcctagaatatcgcctacactcaatttagatatattttgatattttcaaattcaggtgcagatccatggcaagtacttgcgataagcagaaaatgtaacattccaagaatgcacagaatgggatagacagagtgacaaaagctccctctccacctcgccatccttcctgaaatacacctctattccttttgccatctctttgccccgttttctctctagggaacctgatgctttctgtcagccacagcagtaggcacttggaacttgataaagaattttccctctatgcttccctgatacattcataccctggtgtatcagaagggttcttcaaatgtcaaaaacaaaaccaaacaaaaaagctttagggaaatgcttcgtctttttacatcatggtctattttctaatcctttggggaattttttcaaccttttcttgaggcacatgtcataatgcaaggctgggaggaggcatgatttggcaaggactggagaactggttggaaccagacaaaagccttcctgtgcaaaaatgtaggagtgtgagtgtgttcacctggttagcagctcctgggtctcctaagtccattatttgaagattaaaataaatcaactgcatttccgggaccactaactctattctccggagttacttaaaggtttagggaaggactttttttttttttttaaaaaaggtatgctcatagaatcagattattttttttttcctggctacaactttagttgtcatttctaatttttgctgtttagtctctgtttgcattgcatgggtccttggttatcctttgtattagagaactgaacttctaaaccataagctacttatgggaagagactatattttctatttattttgcatcccctcccccacaatcccaaactggctttcaaaataaagtggacattcagtgaagtcctattagctggtcaatgtgcttggttcttcctcaatgcatgatacatagacctcaattatttcaatggtcactgccagccttttatcttcagtttgaggttttaaacaatatccctgttgatttttcctaaggagacggtctctgagaaaagttttctcttctaggaactttaagacagggattgtgagggagtttaaaggaaaaccaaattcaaagaagcatgggtaggtctttctggggcaagtggcaaaaacaaaaaacaaaacaaaacaaaaaccagggcagccttatggggatctctggctcttattccagagctactcaggagtttccccttgaaagaaacctagaaataagtcagcccggtcagagaatcgagccagaaattgaaccatgtcttggatctaatcctcgctctgatactctctaacttgatgatcttaaacaggcaactgcccatttgtaaacttcatttttctcatctctcctccccttctcctaacttttggtgtggttctacgaactctatttttctaagacccttctgggcaggcacttctagctaatactatactgaaagtactgctgggcacagaaagagtgcaggtgaggaaagaggataaggaatttaaataggaaatctatgccctttgatgtgtttaaggaaatcacacacaagtccatatcggcattgtcttcagaagcaaatgcgagcagaatatattctatacccctcatcccagagttttgttttttaaagaaggggccaagaacgccaacacccatattctacttaggctctgtcatcctccctacaactgagattaaaaaaatatagtgccctctctacagaaatatcctcccataaaaataaccagaatgggttttccatgtgttaataccatcatcaccatttaatttttaacataaactttacaatatgtacaattttatttggataatacacttacgtgtgaattgtagaaatcaagcatgtatattatatacatgtgtacacaagcagttgtattcacaggataagtgcatttgatcatctctgatctatatcaagtggcaagctgacctcatctgatacaattagatatgaacacagtacaatgtatagggattgaatgggaaacagtaactgcatattgggagaacttttcaagtatagaccccacagcactttcaaccctgttcaccaaaaagagatggggtatctggaaaggtctaattttgtctccagtgaaaataaacagtacttttggaaggaaaattgcctttacatagaacccttcactcattaaatatcaagcaacacatttagcttccacctactcaaacttctttttctttgagtccaatcatgtctactatagccatggttaatacaaacaggctccatttcagaaacaacgcatgtccccttttcaaggattcatgcacaacagctatgcacaaagaaacagtacaggaatgtgcataatgttaacgaatatatccagctcctctgtaaggtatttagagttctcaaattagtgtttatttaggtcttaaaccgcaagggatttcagtacaaggtacttatttatatgacaactgattattaaagctgcactttttagatttaaaggagataaatttttaatcaccatttaattaacatcaacattttttttctttttcattagcaattctatttgcaaataattcagggcatttgtcatttcctgtgaaggatgcagaatattaaatacacatcagtggtcgacatagcaaatagaataaacaatgtgtgactatatgacagctgtggatcttttgactaattaactgccttggctagagtcccatttaagtgaaactatttcatttgtaaacaaggtgtaattttctatttttctccccagaaaataagcgtgaaatgatttgacagattttgctgcaatgtgtgaattttaatgctttcaccagaaaaactaaatactcagactctctggcatcctgtgaatcagggaagagaaaatcaagagtaatccgtggatgcccagtcatggtgctggctaaaataacgcagagagatttgcagaggacataacagtaatgagtggtgagattgtgagattataatcctgcaagtctctctggcagaaagatagacctatagggacttgccagctcagagcattgaaaccataagtggcctaagaacctgcagatgtaaggatgatgaaacccattttccagaagcacaaaggtttctcaagtacagtttatgctctagaagactctcttacccagagtattttaaattggttgcatgtgcgtgctattacccatggacagagacccaaccgtttgcattcaagtgtacctatctgaggactagttgggtccttctcaagtggggaaaaccaattagaattaacaaaatatcattatggatgccagctctgacttaagccagctgaaactcaggcatttgtgttcagaaatttgggctccttgacatcaacaaatctaagaactcagagctgggatatgttacgggaatcttctgtgatagatctatagtctcaggcttccaggcttcctatttaattcttgttacttctcatactgtgggttccatttaccactggacgttacattcctgatattctttttgcaaagactgaactgacttagatgacctttgaataactctacatcttttccttagaaattgaccatctgatcagtagttgattttttttttttttttttttttttgcttgggatcatcacattgaagagtcattgaattagtagagaagggataccataaactttgtgtagcataacatttctgattatttatttgaaaaaacacttcggtcagtgaaaagaatatatatttttttcacaacattactgttgattcttccaaaggccacgttttcagtttctttatccagagatgtatggggttaatagcagaaataatgctgctgttaggggaaggctttctgaccgatgaagtcagtccaagtataactctcactctccctggaggtctctgtggcatttggcagccccctgggtttagaggacaccagaggaagacagaaagcctctttggcttgacgacaaatcactcttctgtattctgggaagactttttaattcattcatgtcaaaacatcccagactcatgaggaaatggaggcgatccttgctggggtggattaaggtctggaatgcactggaagggcagaaggtagaaagggctaaaaggctacacagtcatggagattcagatttaggatcagatgttggggtgactattctgggcccttcgatccaggcttctccatggctgggtcttggggcagcagaggtacagcatccgggaaataaaatgtcattttcaagcacatgcatccccagcacctagtcagccccttctgcctttcaaaaatgaaaggaagctcctctcacccactgcctccctctgtctccctatgattgaccctgaaatttattgcaaccacttttcattataggaacactgtaggtcaggtgtactttcccaaagatggagctattccatgcatccttgagctttaagggaatcatccctgacacttgcccacatgcaagaaaataatacttacaaaacagaacgcacaccatgaggagaagaaatgggataatttttcaacctgccactttatccctttcttcaagaatgtaaagcagaatgcaggaggaaaccaggaaatggccaggcgagtctacattagcttagtgtttccgtaatggcccaaaacagactgaggtcttctgcaaacactgatggctagttatcccaaatacttcaaaaatattcatgtacatgaaatacactaattaacagagtagaactatataaaaggtttagttaatattatttgctggttttatgatatttaatttttaaactagaaaatcctgatctgagaaagtgtcataacatagcaactatcttgtcgggggcacttgtttttgtggcaggcactgtgctaacaggctccccatgcataagtattcccctctctgtctctaacttaaaaaaaaaatggatatcatttcatgtcatatatgcacaggtttgaggagaataagaatgggataatgcaggcgactcagaaatgacaaatactttgaggaatttttcctacatctctgttggtgctatgaagtggtttgccaccaacagagagaataactcagaagggagaaattgcttgtctcactaaactgtatccacagtttggaggatactcagggtagatccaagagtgcctcgtgttttgaaggcttttgatttgaggagtttggggtggaagtgagtgtccaacagaatttctggatgtgaaggaagataaacctaaaaccatgctagccttcggcagacagatggcattgtacttcttacagatcacagtacacatacggctgttggtgcatgtcaccacattaacaactctgggaagagcgatacacagctaattggacaccaccatggctgtttggaaacggaacgagttatggttactctgggagggaaggggtaacagatactatacaaccctgagtcatcaccagaagggaggaaatgcaaacttacgtacataggcgtcttcgggataaactacaatggccactgtgtcacagacagaagatccacacttagatctcggagacataaatgtgttagtttatgcagctctgaacaagaccatcgaagccgagggtgagagaaacacacatcaacatccaaagagattcctgtagctctccccacctgagggtccctcgggcctttggctccagatgtgtcttggaaatgaactataatgaaggtagcacagtcatcacgaacacactgatttgctattctttaggggagcctggagttcttggggtgagcctgggctgtgatggaaggcataacaagaaagctgaaactgttacgagccaaacttcctaatctcttgcacatgtcaatcgcactacagtgcagatgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcg

SEQ ID NO: 2407 - DNA, 295072 bp, Homo sapiens
gcgtctcgcgtctgggaacggccgggcccccagcgggctgtggtcgcggggtgggggccggagcggcgaggccccccttaccgggctgcgcgggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggtacgccggccctgcgtatctgtctcggggtgttggggagaggggcttcagggtgggcgtcctgggagcggcggcacctccccaccgcgtattgtcccgggtaatcttagacctctagggtgtgccagactccttgacgagggggaggggtggcgttggtgagtcccattttgccgaagggaaaactgagctctggcttggcgcggttgctctgctagctgtgctagctgtcacagaattgcgactagaagctgggtttcctacatttgtagctccatctccccccgcagacaagagtttttgactagagaaggccagccttttcctgtgttgtgcaaaaaggcccttaggattgtaacattttctttggaacgatcttacgcatcttctaacagggaaaaagggactttactatagaggcacttggtgccaaggttaccacctggtgtacctggaagggcttagctgcttcagtgtttcttgcactctagcagacatctcagagctgacagcctaactctgtcagtccaggtggttcaggtgtctgagtaccgatgacggtacaatatgtgatatgtggcagactggtgtgttcttgcagggagctgttgaatagagtctgggttttgcaggaagacctaggtgcctagcggagtgaaagcttctgtaacgcttttgattttacagaattttgttgaagtggtaggttaaaggagcctctgttgccctggtatcttttatgctagtaaaaattgctgcaaagcacgttatgtttatggcatactcgtcagtttcaaagcattgatcagagacagcatacagtgagatctgatagtatgtagtagttcttatgaatttgttatagacagcattgttggttttgtttcagcatagatagaatgtggttctgtcgtcttagatgtttgtgggagagagaattgtgattgtaacattattagaaaccaaactgtttttccttaatgtgctctgctgagtatacggtgcatcaaaatataatgggctggttaattgttacctgggctaggtagcagtccatcccttgatggcaaaatgctagaaaattctggataaaaatttaatatgttatctccttctcatttctttctcagcagctcgctttggaaatattaatatatctttaatagtccttgagcttaatggggcttgatggtttgtggtgcagtttacatatgtctgtgtattgtggatatgtatacacacagactcacatgctcctaaggtcataattaagattttctttctatagcgtattccatcgtattcattttaagtgtatgggtttatgtggtgaggttttctttttattgttgttaattttttaaaactttggcagactttaaacagctttttctgtatagttttgagaatttgtaaatttttttcttaactctaacttttacagccatgtgtgaaaggcagaggaaagacttttggggctgtaattcagctagtcaggcactgtctgtaatatgcaaaaggctatatagacagcatttactagtctagctgccaaatcttagttcaaatcccatgagttagtgaatagtgagaacatctgcatcatttctttgtgttttgttttgattcgttagggcatagatgagaatataacttatttttagaaattttaaagttgatatattgacatggaagctggtgtattctaaattattgtgatcttttttagaagactgaagagatggctatttcataacattagtctaatctacctgttatacatttttctcaacctctatattatatttaacaataattcaagatttagagcattagtaatattaactgtgttgaataaacatcctatgcccccgtatgtagttgacattattagagtaatacagttttgccctcttgacagccacagacactgttctattttaaagatttagccaaaataaagggaataacgtattaatggccacagaacattttgtagtcattagtaataaagttctgaatactacacttgttttttgaagagacactttgtgtcagtaatttctcaagataccattatgtctgtgttatttgagattaatattgtttctaagcaggttgtaatttaaaatttttaatctcttttaaaaatagtattcttagcttcttaatagcctcatgttaggtattatattaaatggctttcttaaatggctttgcttaaaagcaacatttgttataaaatagcaagatttttgcaggttaaacagactttaaatactagaaattaagaatttgaagaggttatctgtagaacttttgagtttgattaaaaacaaatattattttcagaagagacaaagattctttattgtgattcattttggaaaggatgaaaatagagtaagggaatttaaaaagaaacttgccataaacattgttttattttttgcttttatctaaactttgtgacagaaattgatttttcaatttaataaggtattgtaaagtgtacttagcactctcttgtcttgactagttgctttttattaaaccatattcataacatgacatttagagactagcacagtgaaagagtaaaatttaaccatttttgtaagatgtaatactaatcggaaatgttctcatattgtcttctgacaaagtccatggcagaaggatgagctgggttgtagaacatggcttttgtagcactgattcttcctagccttcttttcacttaggtgctaagggtcgccctcccaaagccagtactatcagccaggtgacttaacatctttctggcagctactgtctttagctttgattttttttccctttttttgttgttataatctttaatagagaattgaaagttactctttaaaatatggtttctaatctgaagcttttcctgaatcaattaggtagtttcttattgttttagtgtagtacttagtagtcagtactttgcccgcttatagaagaatctttggtttcacctattgcttggctcgattagttacttgtttcttaattatgaccctgttgtttatttttctgcaaagagaaaagttgtcatttgagtttgaactttgtcttttcccagtagtaaagttgaactttggacctctggtgaaattgttttgtgatatactactatgactaggtttagtttctttgattttactacagagtatatattcttaaaccatttctattctgattaatatacaagtagtgaattttgttctgaaattccccagactctaattgtgcagagttttatgcttcttcatacacctttaagctcatatttcagcagtttgctttcagtaagtttcagtaaattatgtgtattttattccagagattaagtatcggtacaataaatacatgaaatcattgtctactgccatatgcacacattacattcaactaccctaagcaagtagtgtatccagggatggaaatcataggaaacaatgttatagtttgtttaaataaaaaccaagttgaaacagttcctgggtaatgttaaaggtaggtaaaagtcttcactgctgactctttgggacatccaatttgtaagggagttttgttaaaatgggctaattcctagaaatacacttcctgttggtgaagaaacactactggatgctttaaaataggaaatatttatgttattcaaataaaaataatgctgtgcctttcttatctcttgaatctttttgttagtttttttttttttttttttttttttttttagtgggatatttaggatttttgatgagttttgtttaggtggttgtattatatgaggatgggaaaggtaagagaatttagagttaattgttagcctcccaggcttacaatacatttcttcgtaccttttttaaaacaagaaaatctagagacctagagattattttagaaacaatagaaaaagaagcaagccaagcccctttgctagggaaagtagcattacattttgataaaccttgaagttgaaaatttcctatttcaaattttggtagtttttttttcttttttccctaaagctcttaataactcaggggttcaggttttggattctgttcattgacaccttcaattcatatgagtaatgggcttacaccttagcaattgcaagctgatttgcttgcatgatatttgatgacttttattatatcattaacatctttgtacttaaaaaatattttctctccatcattctctaagagtactatatccaaatatctcagtatgtatatatgtatatacgtgtgtgtatatatatattatatgcatatatgtatatgtatatacacacacacatacttttgttaacttttcttgtatatcattttctagtatatcattttgggtactttattgatcctgccctcacccccagacttttataatttagtttgtaaaactttattttcctaggttgaggcattttaataattctttaatttcttgctatcttactggtacaaacaaatacttaacatttggccatttgatttttagatgattttaaattttattcagtttattgctaaaactgattttcatgtaacataactctgtgttcctgggacgtatacattatttttcctctgagatcctggcacatactttataaaaccttttgttttgagagacaaatttttgtgattttttttctgctaatttatgtaaactggcgacaaaacaaatcttctaaattcattcaagtgtctgacttatgaagtcagtgcctaatcttctcaagtgatagtttcatacagagtctttactatgtaacccctaagtgctttgtaatttttggggggacttagtgttttgggagtatgttgaaagagaatcttgtttttatggattacttcagtattatttaccaatttcaaaatctgtgaatgtcagggttgtgtgtgtgtgtgtgtgtgtgtgtgtgtgtgatttgacaaaagataagtgttttggtattgaagactagaaccgtttcgcctttaataaattattttttgtcttctgaaattttgagcaataattttcttgaaatactacattttggtagatagagtgaatgccctgaatttaaaactattgtctaaagtaagagtttcagaaacttagaagctggtgttatgagacatgtttgtagggaaagaggcaaatccattcattgctcttctagctaattttgctaacaaaatatcttgctaatattttgtttttgaagaacaactattattcagaatgttttccaagaaaagatgcatattttatttaatacagaaaaaataagaagtcctattactggcacgcattcattccctcagcaaatacttagtggtgcacccaccaagtgccagcatggagctagcactggcgatataaacatgagtcagaaattgtgtgtcttcaagaagctggcagtttagtgggagcttaatgactcattggtaaggaatacctgtagtaagggttttgcctttttcacttttctgccagtgtttaaaactctttaggtaggtcttagtatgaattttggtgaaaatgagactaactggctgcatagtgtgctattcgaaaaagtagtggagctgcattttagaaaggatttgggttctcaagtcatcacaaaaagagggaaatcaaatataagcaaaactgtcttttcaaaaagcccttaaattgtgcataaaatactatattgtactgtttgtaggatgagtccaaatgccacttttccacccatgttggaaccaattgcagttttttggtcgaataccagaagaagtaatttgcttgcattaaaaagatatgttttacaaaaaaacttttaattctaagaaattatcctcatctaggtatgtacagtgaatttatggaaattaaatgtgtacatgaagtgaaagaatgatttcttttctttttttctttttaatatcttggtaggatccacgccatctgcccttgttttctgacttgagtggttgaggaatgaattgtgaataattttgaacttgtttgggttttgaaagatgacagattttggttgagtggaattaggatctttccagtagtaggtaagaagcagaggaggagaaaaacacagggcaaaaacgttccatacagaaaggtttacagtgtggtccatctcaataattttgtgtgtgtttgtgtacaagggcacaaaatccacattatagaataattggaaattattttgtacaagggcacaaaatccacattatagaataattggaaaatagagggaagatcatattaattgtttaaatgtataggtagttccattatgaatagtctcctgtaagttttttttaaatgtgttatctcctcgaaataatgctctaaggtgcttaatgctatttctgccttcagcctcattccactcataatgttatactatgaatatttttatttaacccttaatgtaccattagttctgttctttatggttaatagccctatttttgttgttttggaagtctagccagttttatgggaaaacacaatttgctagcctaggaaaaagggaattgaaaaatatattttcatcttaatcccgccttcccttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctggtttttttgcacataatttgaaacacgtaattattattttctggcttcaggggagtttgtgagaggcaagcctgtatctcgttgttctgattgggaattacacatgactatgaaaaatgggattttactatacataatggcatttaacagaagtagttttatgaaaggaaaatatcctacaaggtaggaaaaaaacaagtatttattaatgcttcattttctgaacttaaatagaattaagctaaattggctttgctttttcctccaataaaataacttttaaaaattcactttaatggagtagttccagagatatattactctttggatatggttatctagtttgcagcaagtatcttgtgatatatagcttagatctcagcaggaaagaaaaaaatcttaatttacatatcagtttctgtatttgtaagaattctgtagcaagtgacagaaacgctgttgagattaatgtaggctaagaagaaatttattgacttacatacattaaaatccaggcatagatcagtaacagctaacttctgttctcaagtgttggtcattagaattattatttggttctcttttcttctgggttggattttttctcagctagactgtcagtgtagcggtgaaggtagctctgaaccccgaagtcatacagggtccttaaagcttctcatctttttggagtctaataacaaatctcatgcagggactttggccctgtgcccatctcttggaccaattattgtagagagaggagaggacaatgaagtgccatgattggtcaggcgtggggacatgtctacccttgcagctgggtataaatagcataatatgattaataactgtagcagaaccccaagacgtaagggagggggagttcctgaaagggtgggatgccgaggaatcaatactacaggaaatgatctcttttaaaacatttaatctctcttacttggaggccagaagtagtacacagttgtcataaaactatcatttttagaaaaacagatattggctgtaaaccaaaactgatttgatttctaggcactgcttttactcaaatatttaaataaaaaattgcttttatttaaaagttatttctttaaaaaattgaaatactgataccttaatgtgcacaatttaaaagtatttcttgtaatttttatttaattttctttaaaaaaattaaataagattctctaaaatcaatgctgttgatttttagggagatggaatactttggaagattaacagtctttggcattgagaaaaatattattagcctagttaaacaattacgtttttaaaacaattttattctaccattttgaaaatgaaattctaaacgaattactttccaaggtgttttgcttttaaaacaatggtctttttaaacacaaattgagacaatgtcattattgtagtatttctgagggctccctaataatactttttaaccatgatttcgtggaaattatgtgaaaggaactacttcactgactcttatataaaatgggtatataagagttttgaaacattacttaagtatggtgtcatgtggtaactgtttaattaccaaaaatgttatttggcagatattgcaggataaaatctgatcccctttttaaagttttttatagcctccactgggagaacagaggtactcagagcaggggtagacagttgaaagagaggggtgggtgctccaaataacatttcatactatttttatattctattactgtatcaatgtcttcagctttggtgccataaaaataataattttagtaataactttgagtttatatatgccatgcacagtaggagttttgtagttttgccaagtgtcatctggtagttggatctttagtgaatattaaatgttggtagattattggtgaatgcacttactgtacataaaaatgaacattcatggaattgggtgtgatttgccagtaagaatcatcatagcaagtactttgtattgttagattagtttgggcacccttcggatgactttagaccatatttggaaaattactgcttctacttcaaaagcctgtaataattagagttctccaatattaattccatatattgattaattaagccatgaaatctagtaaaatgatatagtctttattacctctgttcacagaattgtatctcaatccaacttggtagctttcagcagaacactttgtcaaaatattattaattttagctaagaattctattcactaatttcagtgtttaagttagaatgcacatgctagtgaaaattttaatttcctttgaatagaattagatttgctaactagagcaatctcacaatgtaatgctgatgactgaaatgacacttcagcctcccttgggtgacaaccctaagtttagacaaccttactctaataggaatattgaggacttatcacaacatattagctgtcatttagagtaataacttccatgtcagggcattttatacctgtcttatttggtttataaggatgtatatattagcattcatgttttcttataaagaactttatatatttttattctctatgagtcagatattatcatcttcctttacacatgagaaaattgagttagagagattaacacgtgaaagttcacacagactcacaggaagaattatgaactgacacagcgttgagtctttctttactttctggatagaatattagttcattatatccaaaaaacctgtcttcctttttctagtaaaaggaaaaagcacaattctgaattgtttgcgtgggtgttaaatgcagtaaaacactgggcaagtacttacaataaaggcttcactgcttggttctgtttcaaaacagagtttgtggccgtgcagtttaatctgtacagctaagctgcatgataaagtagttatttccaagaattgctaatcaagcagaaagttagtattcttgctacatttgtaagagaatattttcagcagaatatttttattgcggaaaatattctctataatatgtaaaagcccagataaatatattagatacatattttaggataaatatacttgggaaaattgcatattagaaataatattttgttcttgtgtttcctttctacttcctctgtaattcactcaccaggaaggtgttagcacatttactgagagcctagaaaatgttctggtgaatgtagaaaggaacgtactttagaattagggatcttttataagtatgcagacccttctcacaaaagtacactttgcttgaataaaatttagctaagctaggtaaaagaataactcattgcatttaagtagacctttctccttctagacttcgagtattgcacacctaagatggatcctttgaagaggcaggtaaagcaggttgtggattgttggaacctcttattctttaagtgtttacgctgttatgttttctctctgggctaaagtcagtcacttgagtggaaggaaacacagcaatccaatcttagtatatggataaacaattcgaggcttagcaatggcagaagtcatagcataagcatggtagagcagagactagaactcagattgtttagttcctttcattgttctagtttctggcataagaatttgtgtagaaaattggcgaaaaaaggacctgttaaacatattctgtttctttatgaaatctgcattctcttggaactaagtgtaatgtgctagactcagtttgttaggccatcagtgtgcatgaatgtggttagaggcagtggtatccccgaacctgcagcacaggaaagaattttaatcattatatgccatggattttcagggcattttaagcctttataatggtgtaacttatgattaagatttacacagtcaaaattgttagctggtataatagctgaatagttaagtatttattttggttagttactttagctttagctttgaaaaatcatttttcctatcggagattcttcacaatgctttcagtaaaatgtttctgaatagttcctgctatatggtagactgctaacactgtttcttgctctctctgtggggctgatgctacaagtctgatttagagtcagctgtgcttttatttttttccttgagtgactaggggatgcattgggggaagataaattttagggcaagaggacactcagggttgtgggagatgaactgtcaaggatacctttggctcactgtcctcaagcttgttcggctgcagtgatggcataactgagaagagggattgtgctcttgctgggtgcgggacaagaagatgtctcaggccacgtaaagctggccacagcagaggacaaggtattccctgtgaggcaaaactgaagaaaggggattgaggtggcagttctggggaaactatgtttgttaggtagactaatgggaatgatggagtcttgcttgggctctttgtaggtcagtggaagaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattagaaaatgattaattatgtttttaatataatttaattgtaattttatgcaactaaattcttaatagtggctgtgtttgacaactgatttgtgaaattcataaaaatttaataattggccttgcaagagagtacagccaactccattgcatcactgtaaaacctcctagctgacggttctactccttaattgaaaattctctcttttttgttttagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaacaaattatttcctaattatttgcccacattttacaattatctatgcttttgaatttctttatatctactatatctgtatggtagaaacactatatagtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcatgaaaaagaggcagtatgttaaaagtttgagttcagattttctgatgtagataaataagctaaagaaggcagggtgaagtgtgatatatgagaatttccagagcagggtattcgtaacttgtaagtatttagtccaagttccctctcccaacacattttacactagaataagattgaaaggccagatgtggtggctcacgcctgaaatcactttgggaggccaaggcaagtggattgcttgagcccaggagttcaagaccagcctgggctacatggcggaaccccatctctacaaaaaaatacaataaaaggtaactgggcatggtggtgtgtgcctgtattcccagctacttgggaggctaaagtgggaggatcacttgaacccaggcaggtcgaggctgcagtgagccatgcttgtacctgcatactgcctgggcaacagagtgaaactgtctcaaaaaaaaaaaaaaaaaaaaaaaaaaaagactgaaggctgtcttgaggaatgccacttataaatacatttttaaaaattcagtaatatttttcatgtataaacattgtggagactattgtagttgcttgtacaatactggggcattggtgatatctgtctctttactattgtagctcctgcctacgcctttagtaactgctaaggtgcagactgtagatctggactgtctgtgtctgtggctcacaacctcaacttctctgctgcctttgatttgctccctctgcagttttgttttctctgtactccgattgcttctcccatgcttctctgctttccaaagaaaaaactgaccttgtatagatcctgtcagctgattgcagtgctcttaacttctccattgtgagttgttcagtctgaggagttaggtataaacccagagtggtattctcttttctgttgtgtttggttttgcttacatattcaggagctgctctttacccccagaacatccgtatatatgtttttttctgtttctagatttaaaaatattccagaagcctggcctcaagatagataatattttacttttaatttggtgcccttgttttagagatttgaactggattgcatttagtaaaccaaaccccatctttaaaaaaatcatcttaaaaaaaaatagtgggccggacatgatggctcacatctgtaaatcccagcactttgggagactgaggtgggaggactgcttgagcccaggagtttgagaccagcctgggcaacacagtgagaccttttgtctacagaaaaaaaaaaaaaaaaaaaattagccgggtgtggtggcacgtgcctgtagttccagctactcaggaggctaagataagaggatcacatgagcccaggagttggaggctgcagtaaattatgatcgtgctactgtactccagcctggatgacagagcaagaccctatctctaagaaaaaaaaaaaaggaaaaaaaaactggttcaaattggatttttctattctttcataagatgataaatgaaaaaaaaaagaaaatagatttttgaaaagcaaataatctcttggaatttcttattaaagtataaaaaattatctaattgaggcatgttaatccaatattaaagtattaaaggctgagtgtggtggcacaggcttatagtcccagctactcatgagatttgagaccaggtgaactgcctgagttcaagaccagcctgagcaacatagtgagaccctgtctctaaaaacaggtaaataaaaaaaaaaatttcctctgattacaggagataggtagaaaaaatgtgttacagtgcagatgagaatttccttagcacttttaatgtgaagtttatttagattgggtggccagggaaagcatccctgaggaggggacatgtccattgtgagttgaatgactgggaggcaggcatctgccctctgaaaattttttactcagagagaattgtaaaacacaaatatgagaacctggttcgatataggaatagaaaggctgatatggctggcaccaactaaatgaggggtgaaagtgagagggatcagattgaagaagtagacggggaccagtgggggtctgttagccacagtaaggggtttggattttatttattcttaatgccactggaaagtataaagttggagaatgattggtatgtatgtcaaaaagtcattgtttgtgatgtggaaggagggcaagagtggaagaagggaaaccctttagtttggatgaaaataaatgatggcttggacttataagaatagtggcagtgaaatgaagtggatagatttgagatatgtttttaaagaggaactaaataagacttaactgattgattgcaggtaaggaagggagaggacttcaagagaacctctaggtttttgctttgagtaactggtggtggtactatttccaggaataggaaagacaggaggttgggtggagtgatcagattttttgtgtgaaggagatatatctaccaccaagattattttcttaactttttactgtacttgctttattatacattaacctattcctccatccatcaatctgtcttttttttttttatgcctttcaatgtaaattgcaatgcatttccacaagaaaggcttttaagtgcccagtttttctaattttacagatgagaaaactaaaccttggagaaaaatatgctcaaggtcgtatagctagttactggtgaatctaggatcagcatgcaggttaccattagttcaggactctaatttgattatattttagcttgtaagaataaaagtgaaatttggaaatgggacaagttttcccacgaactcgtttatgtgctaaaatatcttagacccaaatttctatgtcaaaaatgcaaaagatgtagtactacagttgcatttgactggattacaatgttagcacggcacttaggacttgttggaaagtaccttctaatgttgtagaattggaacattttcagatgtttggttcaggaaggtagcttgggattcttccaagcattaatcctcttattggcaaggcatttggattttaattagcaaatgtgccttgcatacctactatgcactaagccccatgcaaggcccagataccataaaagagaatgattcaagttccgtacttcaaagtaattcagcctttgacttctgtgtcaattttctgaaatttctctttttttgctgtatgtttgtttaaaaatataataaaaactgaagttcagaaaggaagagaagcttattcaatctaggcaaaacttcagcctccttgttaaaattttatgcatatgactgacataggctactgaattgaatcaatagctagtagtgtgaagggcaaacagatttttcatttgctttgtgtaagcactttattttccaaggagtgaaaataagctgttttagtttctgtcctatggaattaactagctaggttatcagttaagttggtatccaacctggaagttaatgacttaagttggtacagaaatatgagacatgtttgtctttaaaagtcaaactaattgtctgtctttaaaagtcaaactaattgtctcatattgatattatttttatgctttcttgtaaaataaacattttcactattgagctctgagaatttggattttgaggaaattaacccaatagagcattatgttctttccttgaagtggtcattctctgttctaaaatttaatatcctccaacaactctctcagctcatatcttcccaaactcatttcccattagtacctaatatgaatactcagttacagccaaagtatttgttacacatcttcaaaatccagtcctaaatttatttcctttagagatttttctaggattaatctattactttttatttctgtatttttcacccccaggatacctaaatagttctgtactttgccatatattattattaattttatagctatttagtgcagtaatttagacctacccagcagactgtagtgataaaattgatctatttattactgatgctgaaaaaaacttagcaaatttaagttaatctgtaaacactttctatactggaaggcatctttatacctttgacaagaagagtttctctttggtggaaagtttcaagaggaacacacatgggttaaaaaaggatctgttctttttttttttctttttttttccagttcactctcccaaatttgacaaggaaaaagagaaatggaatggaatttagttccttgttagtaagaattagaaaagtataaaggtagaggagaccaaaattgacatcaatttgaatttatttgggatatatctttcaactagaagtttacttttaaaaatcttctctttttggctgggtgtggtggttcacacctttaatcccagcactttgggaggcaagcaagaggattgcttgagtccaggagttcaagactagcctgggcaacatggtgagaccctgtctctacaaaaaattaaaaaattagccaggtgtggtggtgcatacttgtggtttcagctatatgagaggctgaggcaagagaatcacctgggcccaggaggtcagtgctccagtgagtcatgttcaacataggtaagattgtaaagtgaaattaacatttggtaccttgttactttttttctcctatcccattctcatttttacttcttggtattacttttctgtgtctgcacactgtctcctgactgtctagtctcagcatcctttcttattggcacacactatcacttggcatttttccattgtgtaataggtgggtgtcaggaaagttatttgattaatctgttctatactaggttatactatactgatgtgaggaattatcactgctaaacctactcagggatattttcctcttaacttcctgtgtgaccccaaataacagaatttcaagcaaggctgtaggaacttttctgcaagtcacgccgttaaacgtattctgcctaatgtaaatgattctggaaagtatgaggaagatgttagtggttcctagcctcgtcttttatcaccacatttcttcaggcagctccacttctcttgcctgaagatggtctttctccatgtgttgtttttctctgtgttcttaccagagtcctctgtaacagtattttgttgttcaaaataaattcattacggaataccctgcattttgagattctttgtatatactgaaatataagtcagcttcatcttttctgagtgacaattcttttgaggcattgggaagcctcttatattagaagaaggtctagagcctggattttggttcttagtcctaaatttgaatcctaggtctgccacagttctgtattcaaaagttccataaagaatcaggacaaaaaattgctactaaccatttaccacccagaagccataataataattaattttatttttcttttactattttaaattattttggctgtgaccgtcctagacgtgtgaatacatggtcaaaaaatgtgaactttttgggagatcttgataatgttacattgtatctttctggctctagagctcttacatttttcatactaaattgtctcagtctttggggctttattattattattattttattggcagtgttagatcttgtagccaaaaaaagatttttttttcctcttttggttccaaatagtcatctgttattttggattatttgctggattgttaactatacaggaaacttccaggcctcatctcacagcaatgactgtcatgttgataaacaattatgatatcccaggttatgttaaccctgcctaagtagttacatggcccagtgaggatgcctagtagctataggtgattggttctgttttgtctcctacacctaaaattttgccataggtaactgttttgataaacataggatagcgtccttttattctgtatgtaaaaaagtactatatgtaaaaaaggaacttaactcctcactaccctgtttctgtcctctagacagccagatggatcttgtgtaaaagtagaagtaatcttggctatagaacaagaactgttgatatttccattttaaaaagttgaatcagtcttaagtttgagttggtgagtaaaacaaaaccaaaaccaaacctgggataagctaccaataagttaccaaagtatttaaaaacttgacagatgtaaaacattaatatataatttattcttagcaacttaatctgtttattgagtggcagtgtttcagtaataaagctgagctatttggatacactgaccttaatctagtggaaaacaggaggcttttaaattggcacatacacaaatcatcttaggatccataaaatgccttattgttaaattactgtttttaagtcttatattttctctgactacttctgatagtattagtaggcatctcttactgtattttttttttcagaaggcaaatttaggccgtttttataaggtgaatataggtagattttcatatgtattctggtatattgggaattactgccaatgattacttcccagataatccattctaactatcgagtatctagaaatgatatgttttaagtcacgatgattattaaaaaactgctgaattaaataagctacacattttgctggaaattaaacaaaacttactcgcttctttgaaggaaattgatttattccttgatttcttctctgaatcttgaatacaaattaattttttggttttttttttttctataaaagtgaacttggagaccagtatagcacaatataaagcaaggaaagttaaaatcaattaagaatgctttgtttaaaaagagagaagacagaaaatgtacaatttgtttgtgaaagaattccatagaaataacttatttatttatttattttattatacgttaagttctggggtgcatgtgcacaatgtgcaggtttgatatataggtataaatgtgccatgttggtttgttgcacccatcaactcgtatttacattaggtatttctcctaatgctatccctctcccctccccccacccccgacaggccccagtgtgtgatgttccccgccctgtatccaagtgatctcatggttcagttcccacctatgagtgagaacatgcagtgtttggttttctgtccttgtgatagtttgctgagaatgatggtttccagcttcatccatgtccctgcaaagttcatgaactcatccttttttatgactgcatagtattccatggtgtatatgtgccacattttcttaatccagtctatcattgatggacatttgggttggttcccagtctttgctgttgtgaatagtgccgcaataaacatacgtgtgcatgtctctttatagtagcatgatttataatcctttgggtatataccaagtaatgggattgctgagtcaaatggtaattctagttctagatccttgaggaattgccacaatgtcttccacaatgattgaaccaatttacactcccaccaatagtgtaaaagtgttcctatttatccacatcctctccagcacctgttgtttcctgcctttttaatgattgccattctaactggcatgagatggtatctcattctggttttgatttgcatttctctgatgaccagtgatgatgagcattttttcatgtgtctcttggctgcatagatgtcttcttttgagatgtgtctgttcatatcctctgcccgctttttggtggggtttttgtttgttttttttcttgtaaatttgtgtaagttctttgtagattctggatattagccctttgtcagatgggtagattgcaaaaattttctcccattctgtaggttgcctgttcactctgatggtagtttcttttgccttgcagaagctctttaatttaattagatcccatttgtcaattttggcttttgttgccgttgcttttggtgttttagtcatgaagtccttgcccatgcctatgtcctgaatggtactgcctaggttttcttctagggtttttatggttttaggcctaacatttaagtctttaatccatcttgaattaatttttgtataaggtgtaaggaagggatccagtttcagctttctgtatatggctagccagttttcccagcaccatttattacatagggaatcctttccccattttttgtttttatcaggtttgtcaaaaatcagatggttgtggatgtgtggtattatttctgaggcctctgttctgttccattggcctatatatctgttttggtacaagtaccatgctgttttggtcaccgtagccttgtagtatagtttgaagtcaggtagtgtgatgcctccagctttgttctttttgcttaggattgtcttggcaatgcgggctcttttttggttccatataaactttaaagtagttttttccaattctgtgaagaaagtcattggtagcttcatggggatggcatttaatctataaattactttgggcagtatggccattttcacaatattgattgttcctatccatgtgcatggaatattcttccatttgtttgtgtcctctttaatttcatcgagcagtggtttgtagttctccttgaagaggtccttcacatccctggtaagttggattcctaggtattttattccctttgtagcaattgtgaataggagttcactcatgatttggctctctgtttgtctgttaatggtgtataggaatgcctgtgatttttgcagattgattttgtatcctgcgactttgccgaggttgcttatcagcttaaggagattttgggctgagacgatggggttttctaaatatccaatcatgtcatctgcaaacagggacaatttgacttcctcatttcctaattggataccctttatttctttctcttgcctgattatcctggccagaacttccaacactatgttgaataggagtggtgagagagggcatccctgtcttgtgctggttttcaaagggatgcttccggttttagcccattcagtatgatattggctgtgggtttgtcataaatagctcttattattttgagatacgttccatgaatacctagtttattgagagtatttagcatgaagggctgttgaattttgtcaaaggccttttctgcatctattgagataatcatgtggtttttgtcattggttctgtttgtttgatggattacgtttattgatttgtgtatgttgaaccagccttgcatcacagggatgaagccaagttgattgtggtgcataagctttttgatgtgctgctggattcgttttgccagtattttattgaggattttcgcatcgatgttcatcagggatattggtctaaaattctctttttttgttgtgtctctgccaggctttggtatcaggatgatgttggccttataaaatgagttagggaggattccctctttttctactattgaaatagtttcagaaggaacggtattagctcctctttgtacctctgttagaatttggctgtgaatccgtctggtcctggattttttttgttggtaggctattaattattgcctcaatttcagagtctgttattggtctattcagagattcaccttcctggtttagtcttcggagagtgtatgtgtccaggaatttatctattttttctagattttctagtttatttgcgtacaggtgttcatagtattctctgatggtagtttggaatacaaattaatttttaaagaatgttgagtcttctattttattttataaaaattacaaaacatgatataaaaataaaaaataaaatagttacatttactacttagtattaataataaaactgtttggtgggttaatttatttcaatccaagctaacatatattactaaagcagatttaaataaatgatgcttatgtgtaagacactgctggatattataaaagactttagagttccttttatacctgtaacactaattccaattattatgtgaaatttggtatataattttcctaatgagatgacattattatcattacaagtttcacagtatttgtataaatgtgttactagaccaaataatgtaaatctgaggcaaatctttgcatttatagaaactagagcaactttaaattccagatcctcttccctataatgtttttagtagctttcttctaagtgctttgccagtaggacctttagtagcagaagtaatactaataaagtaagcaattatagttcaagcagtctttctgccaaaagttcattcacatttaaaggaaagtaggaatgttgggtgtttttgaattgtctatgccattgctttccagactgattaaaactggcagaaattactcagatactgtgaggatgaattttgtaaccatccccattccccacgcctgatagaacatctaacactaattggctattttcagaggtttgtgtataccagcaatagttgagaatgaatagtttctcctttttttcctatcactttctgcctagattgctttgtgatggctgtgatcttcctttgcctctcttttctatctctccgctcctattatactccagccccaatatgattcttgagcatcacttttgtttagtcgttcctgtttttttccaaatccatgatgatatctcctattgccaactaaaatcttcagtttagcatgcaaatcttacaagtgtggacccagcctactcttccagcctcacatccagttattctctcctacaccaatgacaatggtctgtttctcaccagaatatgctttgtacttctttttaagcttcaaaagttttagtatgttatctccttactccctctcccaatagctgcaccttctgtagtctttaaatgagtgcgttttatatttataaagtcgtactgtatatatagtattcggtctgattatggaggatttgaaagctagtcagatcctaaagctagtgaaagtagccaaatgtttttgagcagggggtcaaaaacatttatatatattaattatataattaattacatatattaattatgtaattaatgacacatattaattatgtaattaatgacacatattaattatgtaattaatgacacatattaattatgtaattaatgacacatattaattatgtaattaatgacacatattaattatgtaattaatgacacatattattatgtaattaatgacacatattaattatgtaattaatgacacatattattatgtgtaattaatgacacatattaattatgtaattaattacacatattaattatgtaattaattacacatattaattatgtaattaattatgtaattaattatgtaattaattatatatcaatcatatattaattatatattaatttatattatattaatatattaataatatatattaattattaattaattaataattaataattaataatatatattaattatatatgatttatatattaattatatataatttataaatatattaattatatataattaataagggaatatgtgattaatctggcactgatgtgtaagagacactagaagagttaaagattagcgtggaaaccattaaaggaagagtcaaatttcccaggataggtagaactgatgcctgggatgaggaagagatatcaggtatcaaagttaacaaatcttgagatacagataatgacagaataagggagattatgaaggagagctggttttaaggaggaatatgatttagattttaaataggtttggttgcaatgatgatataaatatggacttcagattagaacctgagcattaagacttatttctcaaattcagaatggaatgcttagagttctattcaaataaaaacgacaaagttgcatatttattaagaaagtatttgttgctgggagagtggttataaataaagtactataaatagtaagggtgatattagcatatactttgtttctaatataatattaagtaactattgaatcacctttgactaattgtcattgaattagcaattagtaattgattttttaaaaaacttttattttaaaatttcatttattttctttttttcacttctccattgttcttttagaccttttttaaagtgtcagatttattgagtataatttacatacaataaaattcatctattttaggcatatggttatattagttttgatgaatgtatagagtcatataatcactatcccaatcaaaatacagatttcaaaaatcccccataaaattccctggttcctccctgtaggttggtgatcttttgagaatgcaatttcaccttataatgtatttcaacgaaataaaagttttcagttttaaacaatcaaattattatagaagtggattttggagtatagccacgtcttaaattggggaccacatttattgatttctgatagattaatttttattttcagagacagggtcttgctttgtcacccaggctggagtgcagtggtgacatcacagctcactgcagtcttgaactcctgggctcatggtagcttaatttgaatttcttgtatttaactgagcaatttaagaacaggacttaatgtaaatctacacttttactttcctactccctcctcccctatcctttttcccatttaattttctgcctaaaatcagtttcttctcatgatctctgtgttgggctatgtattcctcctgtatatgtttcttccctcattcatagcatttatcacactattataactgatagttacttgtctgtcccgttagtctgtaagtctcactgaggtgcttcattgtcttgatcattatttgatccctatcatctaactcagtgattggcatagtaggtaatagatattttctgaatgtgtttttcttgtcacctagactcaaatactttagaataatattagactctttaaagcctcttcctaaaagaaagaaaacctaattaccaagttttatcagtttttctttctttataatattttttatatcctcatccattcatttttattttcatattcacttccttgtctgggctttttcgacctaagacctggggtccttggtttcagtcttttgtttttgttttttatcttgtatactactgctatttcagttttgtgtaaatttttctcttattcagaaagctcagtgggatctgtgttgtttaccacagaaaatgtaaacttatgtgtctagcattcaagacctttatcatttatttaaaaggttttagtgtctgataacttcaaatgcactgtgatgggtgatttgttaggctgtgtagtttgtccccaacccacttttcctgttatctttttctacttccctacttgaaattttccacagtgtctaatttggttgcttacttttctctgaacatgctttttgctttccagccattacttgtgctatttcactaatctggtatcttcttcttttccatttctttctgagtcttacccaaatcaagtcccaccttcaacatctttgaccattctattccatagagcactcccttttgacctcgtttaggggatttaactatttatgctattcatttgtaatactgccttgtagtcttcttctttctctttttttaatttataaatatgccatcttcttacacaagatggaaagcacatggagtttgaggaccatttcttacatgtgcttgaatctcctgctgtctttaacatagggcttgtgcctagtggtcctcaataaatatatatttgattagagtatttagacacctgtttgcacttatgtatagaaaattaatgagagaatatgatagtgaatcattttatatctgataaaattccaaaatataatgactagtacactaaactttagcatctatgaacagaagtgttgtagaacaactttaaagattttaaagtgaattttacaggaacaatatatattacagtacatttatcaaacacttatttttttgctacatcattgttttcctggaagaaattaatgttggcagataaagctattatataactaaatattttgtaaaaacatttggcttaactaatgcagtacttgtttaattgatttttgatttttataattcttataatgtaaatagtttacatgataagtaaaagtaaatatagagtttagggggcccatttttaggaaattttaatcatacacattatatagggattttctacttttatcttcaatatccacattagctttattaattaaggagtcatatgactgaaagtctcaattgagaagtcatttatcgaatctacattctgtactcttaaatccttatagatgggaaaaacctggggactctacaggttaacttatatttttattactcagtttgggaggaatagaggaatgaggcctttttatcttttagaagatcagaactgttcagagttctgaacagttgtttcatttcaacttgatattgagcagtgaactttgtgattatgcttggtgagggcaagtaaaccaaatggatagggctttaggcatctttgttggagagaaagtgtaagaggctcttttgggctgggggtgtagagtgcagggctaggaggaagagaaagcatggagttttagaaaaaagaaagattgggaatatcccaagagcaagaccttgtatttttggagagtggttggagacatctttttcttcttggtttgcaaagagagtgattggtttccattactgctgtaacagattcccacaaattcaatggcataaaacaacatagatttattatcttacagttctggaggtcagaggtctaagtgggtatggagggctgcattccttctggaggcgctagggaagaatccattttcttgcctttttaagtttctagagcctgcctgcattccttggctcatggccccttcttccatcttcagagcgttatcagtctagcctctccttccgttgtcacatctccttctctcactttgaccctcctactaccctcttagaaggatctttgtgatgatactgtgcagtccaaagggatagaattagaatttgtgggtggaaattacagagacagatttgtactcacattaagggagaactttctaaccatcagctgtaaggatggagtgggcagtctcagaaagcagcagcatgtcctagacattggcagtgttgaatagaggatgaacaacctcttcccagaattgttgtagataggatctataaacattggtgggtctacacgagccttagacccttgccaaccctgagatcaaatgattctctatgcatagctcagtgctattataatttggatatggaacaatccctgccttaaggaattcaacttttactccattagttgctgtattgctttattgccccctttcaatacaacagtaaacataaggcctaaaagaaagactgaaaacaagggctgtagatttaggaacctactgcttagacaatcaaacctacttttgtttgatgaagttcttttgggttaaatatattttcacttgttttgaatgactcattcttccattcaggtgaaaaatactcagactttttaacaatttgaatggatggcattcctaaaaagttatgtggaaaggagtttgaatatttaatcttacacttttccaaataggagaaaaaaaattttttggaatttaacaggcctatgtgaaggctttaggtgaggaacatagcgtccgttcatctgtgttgaatatttcatggttttgattataaccaaccaatatgaaccaatttcagtagttttagttgagagatctagttagtagttcactttcaggtagactcaaaaagcttttctgtatctcagggaatacaagtcaaatgtctgtacatggggggagtggcttttataagctggtagtcagtgaatattgcattgggagagctgaaaaagtttatgtactttcagacatctcataatgtattatgtagcaaatttgttttctccatacgtttttaatgaccttatagattaaaactttttttttttgagagggctaactgtatttttttcttgaaaggtatttttgctgaaacagagtgaaattgaacatattttctaaccagtctggcatagtgcagcatcatggtatttaccttttttccctgaggctgttgtgcctcatgttttctatttaagtatgacttactaatgatacacaaaaaatttccatggtttctgtagcttcttccttatacttcaagcctgtcccacatggtaaatatgcttaagggtcctcttagataaatccaatgtcaagttaaaaattttgtgctattcatttgacagtgaaaaagagatagtcccatttgaggatatgaccagagtataaatcattaagtaatagtattagaaagggctttgacaagttgtctcatctaactctctgctttaaagaggcaagtgacctaattcgttagtttcctcaaaatgcagactctaaaccgaggtttcataaaatccaggctttagagccttcaagaaccctctgaagctgcatgcaaaatttctgtgattgtgtctttttatgggatgagggtccatcaacttttatgtattcattcatgaattattccctacctttcttcagtattttaataaatgttatgtgaagcttgtaccaggtacttggaccatactcttaatatatgattcttcataaacttgatcttttgttttatctacagccagtaggaagtagccaatcttaaaacaaggaaccagatataagggactatggctctgtaattacttctgtatttgctttgaggtgtatttctggactgctcttggattcttgctatacgctaatgtctgaaaccaccttgatttttttttttttcaatctatatgtgtttggatttggctttgcttactgattgtctgatgtggaatttggtgacctggatgctggactgagtgctttcttagaattcatgttgtttttggaatttcacctcttatcattagtgtgaactgactttaaaactttatgtaaaacatgccctgcccatctctctctctttacccttttactgactgtaagggagtaagcttagatagcaattcttgttttttatttaattggaacttttattgagctaactaaattcacatgtagttataagaaataatagagatcttgtatacctttcccttagtttgcaccaatggtaacattcttacaaaactacagtataatatcacagtcaggatattgacattgataccaccaatcttaacagatttccctagttttacttctattcatttgtgcatgtgtatgtgtgacagcatccttagggtgttgcttcactagccggaaacttctgtgccggtggcacctctacttgagttttgctcgcacctgctgggctcgttctgcccacttggcctgtcaggctgcgtttggctcatgatgcctgcccggatcccatacctgccaagggtgagccaggacagagcggtgaggggcatgtgagtgagcgagtgtggggtctggccactgcgcacagacaggcatgccagctgctgcggggcagggtggcggggcaggcagctcccggcgctggcacaggcgcctgctccgtgcaagggtgcatctataccagacataccgcaagcagcttctgctgcgggcactagtgtctggataagggaacgtggtggcgcctgaaagctgagagataccaggaacagcagaaccctattgccctcagtgtggcgagtgggggaggcatgtttcggggggcatgttttggcccaattgtgttatagctctttcagtctcactacccagctctggcttgcagctcctgggctgatccggccccaccgctacttcccattgcatgtgtggctgcctggtgcggtggagggcgggagggctatagtgttacagaaactctggcttggggaatcctgaggtctgggcccccagaagggttgccacccttcacttctgcagtctgagagtatgtcactgcccacagcttggtgagccgaccaagaatgtgttacatacccctttggctcctgccattcagtaggtcctgagttcttgtcccacatccaggaagaatgagattatgtggacaactagaggatgagcaaggcagagaagaactttattgagcaacagaacaactctcagtggagaagagacccaaagcgcgtagttcctatctgcaggcaggttgtcctggtaagtattcgtttttttttttttggggggggggttgtttttgtttttgtttttgagacgtagtctcgcacttttgcccaggctggagtgcagtggcctgatctcagctcactgcaagccccacctcctgggttcacgccattctcctgcctcagcctctcgagtagctgggactacaggcgcccgccactacgcccagctaattttttgtatttttagtagagacggggtttcaccatgttagccagggtagtcttgatctcctgacctcatgatctgcccacctcagcgtcccaaagtgctgggattacaggcgtgagccactgggccctgctgagtctgggggtttttataggcacagaagggagaaagtgtgtgctgattggtccatgcgcagccatgggtaggcctggaaaaagcaccatcccattggccaaaaggcatcaaggaagttctcactcctagtctcagactccacccggtactggcagcccggcctccaggcttcaggccttcccttgcttgaaggtgaggtttcaccagggaccgtccctttcccgcctgggaatctgtctgccaggagcctcccttccatgcttgttggcatccaaagtttcagcctcagaagcagtttctggaggggactgaggtggcgggtggggtgggggcggggactggtgtgtcagcgccaccccaagtgcttgcacacccggcctagttgtgagcctgggcagggagaagccagggagcaggtgcaggcacttctgagcccacgggggcagggggtttcccgccctgcaagagcgcaaggatacccagtctggagctgctgctgggcggcacctgcactagggagtgcgggctcccactttgccaactcagtagggcgcaggactcctgctgggatcacctgttcctagcccctgccagctccaaggagtgtgcagctccagccacccccgccgcctgcccccccgccccccgctgcagctggcatcctcgcagtgaccactccacatgggccgccactgacatcatatgtatatttagttctatacaatgttgccatttttgtaggtttgtgtatctagcaccacagacaagatacagaacagttccatcaccaaaagcgtccctcttattactgctcttttagaaccatacccacctctttgccacccctccttcctaccccacatccaggaagaatgacattatgtgggcaaaaacaagagcagtccagaaatacacctcaaagtaaccactaatctgttttctatttctataattttgtcatttcaaaactgttatctcaatggaattatgtgatatataaccttttgggaatggcataatctccttgacattcatccaagttgttgcatgtagcaattataccaatttttcattactgagtagtatttttgtttaacattcacttgttgaaagacatagactgattccagtttttggctattatgaataaagctggtatgagcattcatataaaggttttaatgtgaccataaattaaaaggtaatattggctcatgagttgggaaacgttccctctttttctattttctagaagagattagcacgttatgtaaatctgggaccaggtgtggtggctcacgcctgtaatcccagcactttggggggccaaggtgggtggatcacctgaggtcaggagtttaagaccagcctgaccaacatggtgaaaccccgtctctactaaaaatacaaaaaattaaataagtaaataaatgaaaaattagccgggtgtggtggcaggcgcctgtaatcccagctacttaggaggctgaggcaggagaatcacttgaacctgggagatggaggttgcagtgggccgagatcacgccattgcactccagcctgggcaacaagagcaaaactccatctcaaaacaaacaaaaaactggtattaatttttgtttacatgtttggtaaaattatccagtgaaataggctaggcctggagatttcttttttcaaagcctttaaattacaaattcaatttttttttttttttttttttttttttgagacggagccttgctctgtcgcccaggctagagtgcagtggcgcgatctcagctcactgcaagctccgcctcccgggttcaagccattctcctgcctcagcctcccgaatagctgggactacaggcgcccgccaccacgcccggctaatttttttgtatttttcagtagagacgggatttcaccgtgttagccaggatgatctccatctcctgacctcgtgatctgcccacctcagcctctcaaagtgctgggattacaggtgtgagctactgcacccagcctacaaattcaatttttaaaatgtttataggactattcagattttcttcatcttggttgggtggtttttgaggaatggtccatttcttcaaaattattgaatttatgagtataaaattgttcataatattcctttattatcctttaaatgactgcaggatccgtcgtaatagaccctgtttcattcctgacattggtgatttgtattttctctatttttgtctctatttagtcttcctacatagaggttactaaattttgatgtttttaaaaaccttccaaagaaccagctttttgtttaattgattttttatttccaatatcattcattttgcttttatctttatttcctttcttacgcttttttgggtttatttagctcttctttttctagtttcttgaggtaataacttattgatttgaaacctcttcttgtttctactataaatttttaatgctataaattttcctgtcagcactgctttagctacattccacatattttgattttatattttcattttcattcaattctgtgtatttttaaatgttcctttgagacttcctgtttgtcatatggattatttgcaagtatgttgattaattttcatatgtttagagattatcctattgtctttctgtcattgacttttagttggattccattatggtcagagaacacaatctatgatttcaattttaaaacatttgctgaggtttgttttcaggcccaagatatggcctttcttgatggattttccattggtgcttaaaaaaaggtatattctgctgttgttgggtggggtgttctatttatgtcaattaaattgttagttaattttgctgttcaaaataaccttgctgattttccttctagtagttttatcagttgatgagtgcagcatgttgaagtccccatctataattgtggacttgtctgtgtctcctttcaaatctgtcaggttttgcttcgtgtattttgaggctctgttatttggtacatgcacatttagaattattatgttttcctagtagattgacccttttatcactgtgtaatattcttgtttgtctctaataattttctttgctctgaaatctactttagcagatgttgatttagctaattcagctttttaaaatgtttacatgatataattttttttatccttttacttttagcttacttaatgttgaatttggaccaagttcttgtagacagcctatagtttgttcatcttttttgtatgcatgctgccaattttagtcttttaatgagtatgtttagaccatttacatttaaggtaattattaatatgttagagcttaactctgcccttttattactctctctatatatatctgtatctatctatatatatatatatgatcatatatatgtctctctcccccctctctttatatatttgtgtatgtatacatatattacttgttacagacagtcaccctgtttaggtttagcatgaaatcctgccacattttgtgggctgtgatttcaatgatgtttaagtcccagagtctttgtgatgttattttgatctgtgaagtttatctgataccactggggctcccatggttccctcttggtactgccagaggaggcagaagggttttgcccaggctggaccacctctgggtgaaaagggagtctcaggcctttgaggccaaagatgcatctcaggagagacgcttttgaaggaatccctcttgccagtgccatctggccccctaacccagtctccctttgtgggacaagagaatctcagaccttgtgggagaaggagattgcttcccctggctgcttattagcaagcttcccagtcataaactctcttgcctttggcttgtcagctttacctggtgttgttgaaagtattcctgttcaatcctggggaggaatgagcctacctggactgccttctgtaccaaattgggggttgggtcatgctgagactggctgtctttcttctgtagagtagagggcacatatagtcctgaaatcccaaattagtttgctgtcctcttactaccgtaccttccaaagttttcttttggctgtctcttgcagtatttcttgggtttatagttgtatatacaggcgaagaacaagagaaatcagtctaagctagcttgtcaggactgaaagtctcaatcatgttttaaaatattttattaattttaatttgagggtaactttttccaacgctgcctttttttttgaggataactcaacaacaagaaatacatgtatataactatttttaaaatgaatcaaaattggctcactaaaattttgtttcttgaatgggtaaactttagttacttgaactttttcttaagtggaacatattaacaggaaagcaatagtcaaatgttgaggcattaaagtatatacaatgaatgtgttctgtgtgtgtgtgtgtccccattcctcatattctccattttttgtgctttctctgctctaatggcttttttcctcactctggcttgccttttcactctcttaatggtatcttttgatgaagagaagttcttaattttagtgtagttcaacttgttgttaaaaatgattaatactttctgaattctgcttagaaatatctggcaagcccaaggtaatgaagatactctttgttttcttctaacagctttattgctttgactttcacatttagatacacagtctatctggaattgggcatttttatttattatgtgagggctcaagattcattttttccccatatggatttttagttcattcagctctatttattgaaaagacatcctttgctcaccacatttgcagtattgcctttcttataaatcaggtctctatatgtggaactctttctggactcactataccagtggcaactggtccaactctttctgaaccactatagtgttcagtagaaatataatgcaagccgcaaatgtgagccatatgtgtaactttaaattttctaatgaccatatcttaaaaagtaaaaagaaatttatgaattttatttaataacatgttttattgagccctacctgtgaaaatattaacatgtaatcaataggaaattattaatgagatattttacatgttttggtactatgtctttgaaattgggcataaatttaacatgtgtggcacgtctcaagttagactctaaattttcaccagaaatacttgatctgtatttaggtttcatacaatcacagttgaataagtaggttcatatgcctaaatttgtccaaatcatacttcagagttttccagtaactgaatcacttatcagttcttgaatttaaattaattaaaaatttaaacattacaaattcagttccttaattacactagctacattttaggtgctcagcactcacatgtgtcttgtggctcttatattggacagtgcagctctattctattctattgtcagtctttactgtagaacatacttttgtaattactgtcactttatcataaatcagagtggtagtataagtcctccaactttgtttttggctattgcctcagctattgctaatcatttaaattttcatataaattttggaatcaccttgtcaatgtccactagcattttttcatcacagtttactactgtttacattgttagctgcatacgtgacaacaagaaatccaaagtgatattgagctattgttaccagtggagggtgcccaggctcttggcattttgaacaaagaattggacaaaatgcacaaagcaatggaagaatgaagcaacgaaagcatgtagttattgaaatgaaagtacactccacagggtgggagtgggctccaggaggtggctcaggagcccctgttacagaattttctggagtttaaataccctctagaggtttcccattggtaacttggtttacactctatgtaaatgaagtagtggcccacaatcagtctgattgcttgtgaaggtgaccaatcagaggctgaagtgaagttacatagttacaccctatgcaaacgtgtgattggttgcggaaagtgaccagtcagaggctgaagtgaagttacaaagctgtactcctatgcaaatgaagactgggcccgtgaccagtttggttgcaggaaaagaccagtcagaggtactttcatttttcatctgcaactgcagaaaaagtaggggtattacaaagggagtagcctctgatccctttgttacttggatgtggagaggtagggtgttccttttaattcagttctgggaagtcagcatgaattggccttaggttccctgcctccagaccctattctcctgcctcaccataaaggctggatagttgacttggttcttttcctaactaaacaactggttctgaaacagtggccttagtgtttcagaaacactaagtgaaacacttagtgaaacactgccattcctttatctgcacctctgcaaataagcttttccagataattctgaatatcagttattcaggccacaaatgcaaaccacagggtaggattttaacatataatatagaagtaaggggaaaaaaagtgaataaatacatttctttttttcttcttattttatcagagtggagtctatgaaggtgttaggaccagggaagaggttggagtagctgctgattttggaaattacatacagctctatcatttctagtacttagcacaaggcctggcacatactaggtattcaaatttttggcaaataaatggaagcattatacttaacagaactcattgatcagatatggagccattgttcttgtagttcatgagtgaggccctctattactgtaaactgagactttttggctgaaatgtctgagtaatattatacaaagtcatatatggcatttggctttgtgactttttttagaatatgaaaagaggtgtttggggacataattacaatagaattgctgtttaatttggtataactcatgatgcatgatatatgactggaaagtgagttgttctgatttaaatagaacactattgaagtaaatcatctcatgtttttaaaatagttctcaaattgtgttcgtactagatcagttatctggctgattgttctaatagaagtatctctacatttaaatgtctttgatttcttcatcaaccaaatgaactgacttactaaattcttgttctaaaggaattttcctgttggaatagactatcctaaagtaacttctacaacagttgttttaagctaggacatgttcaaaagcttcatatgacttatggcattaggttgaacagtcaagaaaacattaattggtttatttttctgataatatggctcactgaatcagttataaaacatttaaaacatatttgatttaaaaaggcatgacaacaaagggtcattttaaatgaatagataactacaaaaatgaatgagcaggagactagggaagctagcgagctttgaaaccactggataacctggggacatacacagacctagtaggtaacctggaaacttggagtaaaaaggggctggggcctgggcgatggagtgagacttcatctctacaaaaaaataaaaaagcattaacctggcatggtggtgtatgcctatagtgctagctactcaggagactgaagctggatcattgcttgagcccaagagttcgaagttacggtgagctatgttcatgccactgtgctacagcctgggtaacagatacttgccttcactatttctattttatattagacattaatatataacttatttgtaagttatttaaaatatatcttcagttggaaattgtagccagtgtaatgacacagggcagagagatgaaaggtataagagttggaaaggaagaaacaaagtggtattatttgtagatgatactattgtctatgtagaaaagtccaaggagtctacagaaaaatcaatagtttagcatagatgttggatataaggtaatgattaaaaataaatagtatttaagtaaacctaaaaccaaaatctattttaaaaaagacaatatttataatttcacaaaagtatatcaagatgtaagtgtgaacagacatgtaagatcttttcagagaaggtaataagattttattgagtgaaaattaaaaatcttaaatggagagaaaaaatattttcagatagggcgactgaatatcataattatgtcatttattcacaaaatgatttgtaaattcatgcaatttcatgcaaaaattcctgtggtttttaaaaatgaaatttggaaacttattttaaaatttgcagaggttaaattatcctggaaacttggagaagaacaagttagggagcaggcacttgatctacactatgtagtattatattactgatgtcaataatttataattttatggaatggtagcttcacagagatagataaatagactagtgaagcagaatataggcacagaagcagacctttatggaaacttaatgtatgtcagagtgacactgcaagtttgtggaaaaagaataaactgttcactatatattgctgggacaattggttatctacatgggaaataatgaagtggaatctctacttcccaccctatataaaaatccatttcaggcaaattaaaggcttaataaaaatagccaacacttatgttgtacatatcatattattgaccttgttctagcactttatatacatttactctttttatcatgttagttaccttcattttttaaaataaggaaactgaggcaagcacagagaagtcaagtaatttgcctagggtcacagtagcagagccacattttaaccaggtagtttggctccagtgtctatgcttttaaccactatgctatactttttcacttaaatgtgcggaacgaaactaaaattttcaatataagggcatttgtttatgaccgtaggatagggaagggttgtttttaaatttttgttattttttttttaaataattgggtctttatatgtttccgagacaggactgaaactccctgccttcaagtcattttcctaagtagctgggactataggctgtttctttttttaaaggaaggattttatgtttatcatgaaggaaaaaaataaatttggctaacttaaagagttatttatcaggagacactattaaaaaaaggcaaatcagaaatttggagaagatatttttaatactgataataagacagaattgtaccctgtaaccataaatatgtagaatttctaccatatcaataaggtataagtttctgttgctccacatcctcttgcacggttggtattttagacttttaaaattcttctgccaagcacggtgcctcatgcctgtaatcctagcattttgggaggccaaggcagatcacttgaggccaggagttcaagaccagcctagggaatatagtgagactccatttctacaaataataataataaataaacattattattgttattattctgatcctggtggtcatagaatggtatatgtatggttttaatttgcatcccttgatttttaatgagggtaagcataatttcctctattaatggccatttgtgatattttcttcagtgaagaacctgtgggagatggaacatgaggctgacagttggcattatgttgagcttgtgagaggtgatgtgattctaccttcaggtactactgggtctgtgcattctataaaaccagagaggcaactatgatcagatctcctgctctggctgattttttatttctaggagatttttcatttgtttgttttcatttagagctgtactcctgagtcattaaatagaacactataaatttgctggtgcaggtcataacatttgaagggattaacatttggtttattctctctaaatccatagctattaggaaataacctaaaacttcaggatttactttgcagaaatgatttccttctaatgtatgctctctcaaaggaatttagaatcctgttacataagaggctatacagctttaatcccattcattgatatttagtgaccagttaaacttcaaaacaatttttaaaaatttccctaatttaaaaagtaataataattatgtgaaaaaattttggaaaatacaaactcatagataataataaaccatttagagaactgtgacttaacacggtatattcttttgtcttttttttgtaacctttgcgtacgtagttgagaataacagccccattttaaaagaggagctttaaattcttattatgccccgttaaaaaccccacaggtaatcataattatttagaaatttaatcacacagatgttgagtcacaatttgtgatttaatttgattacttatgtattttcttatttttattcttatctctttcctggatgtgattttttaaaaagttgtggccactttaaagtcttttgagagatgaaatgggagcatgtgcctgttaccaattaattgcctctcagctccaaattcatccttcattgccctgatttgtgatattagagctgtaccctggtagctgtactatgctacccagaagataccagattatcttctgaccacaaatgcataaatgaacctagccaaaaccaaaagaaccacttgctgaatctagtacaaattgtcaacatgagctaaatggtgtttgctgtttgccactacatttgagggttgtgagttaatcattaaaagcacactgataggccaggcaaggtggctcatgcctgtaatctcaacactttgggaggctgaggtgggaggatggcttgagcccaggagtttcagatcagcctggacaacatagcgagaccttatttccaccaccaccaccacacacacacacaaaaagcgtactagttatactgctctattttcagtgcttagaacaacaccttttacttagtaagcattccctaaataatttgtgaataaaacaaatcaggtcagcccaaattcaagggatggaacaagaccattcagtttttacagctgctctctttattgagagaatctcctctgtcctctgtgcctctctatgttttataacacactgtattataacactggttaatgttgaattgtgattaaaaatttatctcctaagtaaggtgtttgaagacaaggatcagtttcttatttatcttttgctgttcaacaaatatttattgtatgcctactgtttcagtcactgtgctgaagtaaacagaacagataaggaaggttcttgcattcatgaaacttactgcaagtgcagtatttttaatcatactgctttttagcaagtttagtatcattctgctttttagcaaggccttgttttttcattttggccccaaaccattttttatccatgagccttttaatgttatattcttgcaaaatttttatctttagtcatcacttttgatttttatagttacatatttagttgttatgcaatatgtatgttttacataccaagtatgtttaagttaatatactattttccttagtagttaactcttttcttggttattcacttttgtcccccgttagcagtatgtcttacgtattttaagattcagagttgaaattctaaattccttttactcacgggaaattagattttagtgttttgcacaatgccaaatacatagtggacacttaataagcgttcgtttgtagtaatagcctctttggttttctatttcatagaatttcaccaaagatgattatttttgactgacttttaaatggctacatgaattcttgaccctcagcctaagtaaattttttcattgtggatcacaatacctactttctcttttccttcttcattttactcttaaaaatattaatgtgcaaatttggaagtgtcagtttcacaattgctaacctacttgaagtgttttgaaaaatgaaattaaggaaaatttagagaagtggtttattaccttaaaataattaatagcaagattcttcttaatatgttatgtcatagtcacatcatttatttatttactgattcattcttggttcagccagtcatccatttaataaatgtgtttcagtccttatcatatgtgcaaggtgctagtattatgaagaggaattcaacacagctgatatgtggagggatgtctttaatttatatttaaatctctgtgtgagatttgaaatattacaaaagactagagtataaatcaggtggaaaaagggacagcaaagaactgcaaggaacttaaccttttctagcatccagcttgaccattctataaaatatatttagcaaataatattctgatattttgatttgaaagcatgaggctgtagctctttcataaatgaaagatttttaaaggtacttatagcatctgcttattactctaaatctttgtgtcatatattgttgcagtgagtttgtgaggattgaattcagtatttagaaataatgattattgaaaaacatgaatacaaacatgtgcatcttaggaaagttatgtcagatgaattagttaatacctgaatagttcaaaatgatgaataattgttagaattataacatattataaattatcttaactacagatatagggatgttataatttgataattcagaacagggctgaataacaatcattctcccattaatttacaattaatctctctttacaattccagtgtgttttgtaagaaataattttccatgagtgaaataatgtaattgccttctctctctctctatatatatattttgtatatagatgaccagattaagacatgaaaacattagtgagataaaaaccaaagatttctctaatgggcagtttgtttgtaagaatgatggagatgatacagagtagctcatatatttacatgcctaagtgaattttattctgtgtttttatttaaatgtgaataataaatgaatccgtagatcagcaaggaggtttaaagtattcaaaaagcaaaagttaggacatttggggtttaatttttttcatttaattaaaatggaaaggatattatttaaccattgagctgggtaatgttaatagttcatggaggatgcaaaatgattcttttttctcttttggtgctcctttaatgaataaacatcatttttttttaatactgtcaaagcactttggagaatggaattgtagctgcacaacttatattaaagtgaagttactcttacaattctgttattctgttttctttttttccaaattttaaagacagtcttttttttttttttttttttgagacggagtctcactctgttgcccaggctggagtgcagtggcactgatctcggctcactgcaacctctgcctcccaggttcaggcaattctcctgcctccacctccagagtagctgggactacaggcgtgtgccaccacgtccagctaattttttgtatttttagtagagacagggtttcaccgtgttagccaggatggtctctatctcctgagcttgtgatccgcctgccttggcctcccaaagtgctgggattacaggcatgagccaccgcacccggcctggaaaatattttttatctccctttatttctttgattatctgccccactcccatgcttagcctagtttttacatacttttatttaatattaatattttataagttttaatatttattttcagtcttttctttccccttccccctccaaaacaggcttggaactaaactcatctttatctattaatgttaaatgagaatagtaaagttggaattagagcaagtacatgttatttttaaactgattactaattcagtaattcataactaattaaatgtctttatttttctagacccttactctcctccttttttctttcttgcccatctcattatcttataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttttaaactatatatatcagttactcttatcagtccaaaagcttatagaattaatgctcctcctccttttccttttccccttcctcctcgtcttcctccttctccttctttcttcttcctttcctcttcttcttcttcatttttctttcttcttccttctttcttcttcttccttcttctttcttcttttcttcttcttcttcttcttcttcttcttcttcttcttcttcttcttcttcttcttcctcttcttcttcttctccttctccttctccttctccttctccttctccttctccttctcctccttctccttctccttctccttctccttcttcttttcttttttgaatatatagagacagggatctctctatgttgcgcaggctggtctggaactcctgtgctcaagtgaccctctcacctgagcctcctgagtagctggaactacaggcatgagccactgtgcctggctctgcaagactgatgtagcaatctttttgtttgaggctggggtgacaaggttgttgctatgttgcccaggctggcctccaatttatgggcttaagcaacaagcccccttctcttatcactccccattactagctccaactgttcctatttacttatagtcctgaaatacagtagtccccctgtatcctgaggggatatgttccaagacccccattggatgcctgaaactgggcataatactgaattcgattgctggcaatcagaacacgtttctgttcacatcttctacccataaatttaatgccttttccatcttaactaagcacttatcacatactatggctgtaacttttgcagtttgaggtgctatattagtccattttgtgttgctataaacgaatacctgaggctgggtaatttataaaggaaagaggctttatttggttcacagttaggcaggctgtacagcaagcatggtaccagcacctgcttctggtgaggacctcaggaaactttcagttatggtggaaggcaaagggggagcaggtgtgttgcctggtgagagagagatcaagagttgccagcctctttaaggcaactagctcttacgtaaactaatacagtgagaattcacttgttactcatcacctcccactaggttccacctcccacattgagggtcacatttcaacatgaaatttggaggggacaaacatctaaactctatcaggtgcagtagcagaattagtacaaatatctttttccttcttcacaatctcacagatagaatattcattgttactgtaggtcttggcagcctcagcattcaatttctttttcccttgttaagttgagaacttttaccttttcacttaagaggaagtgctttatggcttccctttggcatatccaaattgccagcatcactattcttgagctttggggccattattaaataaaatgaggattacttgaacacaggcactgtgataccgtgacagtttatctgataagagagcaagctaataagtaactaatgagtgaggagcatatacagcatggacatgccagacaaagggataattcacatcctgggtgggatagagtggaacagcacgagattgctactctgagcagtgtgcaagttaaaatttatgcattatttctagaattttccatttaatatttttggaccaatattgacttcaggataacaaactggtaagcgaaatcatggataagcagggactactgtatttccagatttcttttccctctgtgcctttgcacatactgtttcctctactgagagcatatttctgctattgcccttccctttcttatcacctggcaagctctttttagcctgctcagaggttatttcctgaagccagtttattacacttcctccttttctgtattcctcctatagcatctgatgtatgcctttaagatgactatactgtagtgttttatcacctcccttgactttgagctccgtgagaacataaatggattatttcacctctcttcatgatttggacagaacactcaattgttagactggaaaggagaaaggaaactaaagtttgagtgtctcttatgtgccagggaatgtgcttaattgtgttgttttagacacaatggaataaattcaattgccacaataaattttgtaagaacatactatcataattagtatatatttttattacatattatctccatcttatagttcagaaaactgaaattaattaatttccccagttattaaatactagagccaggactcgaaccaaggcctgttttgactctacggtctccggttatttcattttactgtgctgtttctttactactagtgtaattgatgatatgatcttgtgtaatgtaaagaacatggacttggacatcatacagacctggatttgagttctagtttaccatttaactaatgttgacaagtgtcttaatcgctataaatctctgtttcccccctttaaaaaatgtggttgttatcattatttactttagaggattattgtgagaattaaatgaaataatgtattagagggttttgtgcagtgctgggcacatgatagatgctttataagatgctagttgtatcttatctgatcaacagataagttgatcaacaggtagttgatcttatcatagctacaagcaacagaaaaacttacagtggcttacagtggcttagcaaaaaaacttttaaatggcttcacataataaaaagtttggagatagtcttcaatgacttaagtttctttctttctttctcatagtcttaggatatctgtgaagttgcaggtgttacatttaaagcagaaaaaggaatggtatcatctgtgtctatatcttttattagaagagaaaaaaccctttccagatgtttcctttgtatctcactggctggaattggttacatggactactgtaatagcttagctgctctcctaactccagtcttgccattatctaagctgtgaaaaacactggaaaagtggagaacaagttgattgtgattagatcaacaattattcttctactagggatgagcacattgctccctcatataaagttacagaagtgtcttgtacagttctggtggtggtggtgatgatgatgctatgtgatgacatagcactgaaaaccattgcaaggtatgcttatcatttcattagtctgaagcagttaataagtaagcattgtgcattgttttaatccatatcacataaagactaagagtagctcagctatgtccttatatttaagtgctaacattttacaaaattggctttacaggcattttcttatctcattagcttaagaatgcttaaaaaaatgctgcttctgttacttctgattgttcctaccctcctgacacacacatcaaacaacaaaaccaagtggacaaccgccactaccagatatataacaaagaaaccccttaacattgctggagtccctctgatagttttttgtctcctgctctttttggagatctatagcttcaatgtcaacttccggaagatgatagtattcttaaggccactttttctacccctaatatctcatgttgggatttcccctttcactcttaccagactcagtgaaaacaaagggatctgctatagttctgccttctacccctcagcttcctattattggagccttccacaattattagatctccttctgccttctcaccctgttgattttgggctgactgggagagaagaggaaaactgaactgtgaagctcttgctgcgttgccagtgattgggaggatatgttacccaatgctcgcttgggttctgggatgaattttgccatagaaactggtataatggatgtttgggttgtgtactattattgcttctctagttcaactacattttggcttttgaggactggcctgagatctataaaataccactatatatgattcctttagggaaatactttgactgccaaccaatttgaaaacaaacattcagagtagaatatattaaatcatgagttgaatgacctatgtttgggtttttaccattctgtaccttgataggatgctagagtaatacacactcatccccagtaaaaaggcagaagctaaggacatggataattagttgcctgattagtccctctataataaaaaagttaagaacatggaagattcgtcttggttgcagaatgaagtatgttctttcctatgagtacttcatatgtattaattttctttttaatatttacatgttgaagcagttatttttccattaggtctttactcagagagcttagagatctatatgtgtagagaattaacatctgattattgcatgatttcattctttggcttaactaaattgttttacaaatcgaataattgtttacttttgtattttaaaaattttcttccagtgttttctcaagcaaatcaatgttaatgccagattttctagatccttagatttactagatggtttttagtcattcagaagccacttataatttagtagagtaataaacataataatgattatcaggttcagcttccaaatatttgagagagagcatatatatactttactgtgacaacttttagaaactgttttgagatagatgaagaaaaggcagaagatatgttgagaagcagatgttgtatgacggaagtacccagctgtgcactaacaaaatgaatctcatgccgattagttaacaattctttggcagtcagagacatatgtaaagcagtgaacacagcatggggaaataaaaaaaaattaaaagcattttctaagcctaaaacattggcagtatctagtctaccatatgtgttactgaagaattggttttattgtggataagtcataccaaggtcacttgcaaaaaaaattggttaacccattagagtcttcattctcaaaaatatatatgtgtatatatatatgatcattatgtatttcatatatatataacgtacaggcatattatatgtcatgtatacaatgatcgtatatataatgatcatagcagtgagtttatatatgtattatatatcatacatatatatatataaaactcctgggctcaagggatcctcccacctcagcctctcgagttgctgggattacaagctactgtaactggctccatagccttagtttagattcttcatcatccttatcttgactattatgttagcctcacagctgctagttttgtctgatacagtagatagtttagattgtttaatgatttcttcataacatatatgttaaagtataagatcctcaaaatttataatttgccctcagtttatattagctgggcatttccatcttgtattatattgtaaattctttgagtggagcctaacatctttttattcatcactatgttgtggacatagtaactactcagctaatagttgttgacttaatgagatagacctaggcagattcttggcttagcaattcagtatgccttgctcaaattaaaacgaattattctgttagtaggaataataacattattttaatatattaataattcacacataattttacagtagtaatttatacagcccgctggttctgttaatttgaattagtaagatgttaagctattatgtgcaatggttctgagttccagtagttctgattagagttgaaaatttttaatgcacagaatatagtaatgtctaccttcttgaagactagcaggaagctttgttttggttagaattactttctttttcctagaagggaattaatggaattgagtaataacaagagcatacactaggttttggatatttattgtggtacagagtaaaaattagcagacgactcctcattagaagttttactcttgatcagaagtttataaagcttattttaaaagtttataatctttaccttgtataaataagtctttaaccaagatcatttatgatgcttagaatgtaccaatgattcgttacttaccctaatggaatattgtgagtaactggtacaatcccatccgtagtttttgttttagtttgcaacttttctttttaaagtcccttttaacctaaagtttgattaatacattgaaatgtgataaaaattgttggttacctgttgtgacattgtttttaagaaaagtgtttatatcatgaaaacaagtttcttacagacagactatatgttttatatatttattcattttgtaaaaattgaggtataatttacatatggtaaaatttacccttttatagtatgcatttcagtggtttttagtgtattcacaaagttatgcaactatcagaagaggattttggtaagacggagtgggaagcatcagaaggtcttacctcacctagacaacaactgcactggcagaatctgtctgatataactattttggatctctggagtctactgaaggctttcactttccagggagaagatttggatctaattgtggttatttttggtcagttacagctcttcgcatggtagcagctacccatccactaccccagccccatggcaggcagttgtgccaacaggtgttccagaaacagttttcacacagctcatgggagctagagtgggcaaaaagcaccttgtcctccaaatattggggatctgtgctctgattgctatttctgctcacagaggtgcagagagaggatggcagcctttgttgtatacctacccccattgttgcagtcccctcccccttcagctgaagtgattccaggggatttaaagggttagcacctttacctcctcatttttctctttttgggagcagacatgaaaggctagaatattcaaaaacaatggcatatgtgaggaaaaattagaaagtgactgtgcatgcccagggaaaggcacaggtttggaaaagacctgggaaaaccttaagtttacatttcaggctgatcattggcacaaagacaataccaatcaagacaaaaacaataaatagaaataacaacaaaacccagcaaaccctgaggaaagaggagaatctgatttccagagtaaccatattattagattctagttttcaacataaaaatgacaaggcatacaaagaaacagaaaagtatggctcattccaaggaaaaaactgaatcaacagaaactcttcctgaaaaagacctcatgtcaaatctacttgacaaagactttgaacaactgtcttaaagatgcttagggaactaaaggaagacgtggggaaagtcaagaacataatgtatgaacaaagtggaaatctcaataaacagaaaacctaaaaagaaaccaaaaagaaattctggagctagaaaatacaataattaaaatgaaaaatccattagcagaatttaaaggcatatttgagcaggcagaagaatgaatcagcaaacttgaagagagaataatggaaattattgagtctgaggaacagaaagaaaaaatactgaagaaaaataaacagagcttaaggaatctgtgtgacactaccaagtggaccaacataaacattgttggagtcccagaaggagaagagggagagaaaggggaagagggaatatttgaaggcttaatgctgaaaacttttcaaagctggtgaaatacatgaatataaacatccaaaaagttcaatgaactccaagtagtgtgaacccaaagagacccacaccaaggcacataatcatactttgacagccaggtgtggtggtttgtgcctacagtcccagctactcaggaggctgaggtgagaggatcatttgaggccaggaattcaaggtcagcctgggcaacatagtgagaacccacctctctaaaaaataataataaaaaaaatgagtcaggtgtgttggcatgcacctgtagtcccagttactcaggatacttgggaggctgagatgagagattgcttgagcctaggagtttgctgtgattatgccaccacactccagcctaggcaacagagcaagaccctatctcttaaaaaatcatatttttgaatgacagagaatcttgaaagcagtgagagaagcaacttatcacataccagggatccttaatattattattggcagatttctcatcagaaactttggaggccaaaaggctgtcggctggcatattcaaagtactaaaagaaataaactatcagccaataattctatgtctggcaaaactgtcctaccaaagtgagggataaattaagacattctcagataaacaaaagatgagggatttcattaccactggatctgtcctgcaagaagtgcttaagggagtactgcagagtgtaatgaaagaagactagacagtaactcacagctgtatgaaaaaataaagatctcaataaaggtatatacatgggtaattatgaaagcaagtattattgtaacaacagtttgtaaccccactttttttgttttcttcatgatttaagagtaatacattaagaaaaacaatcattagtccaaaagctagtattattgtcactttggtttgtaactccacattttttttctacataatttaagaaactatcacatttaaaataattattagtttttgtttttggccacacagtgtctaaagatataattttgtgacatcaacagccaaaaggggaggaaatggagctgttatgggagcagagttttagtatgttgttgaagttaagctggtaataatttaaattagaatgttttaactttagcatgttaaatgtaatccccatagtaaccacaaagaaaatagctatagaatatacacaaaaggaaataaggaaggaatttaaacattttactacaacaaagtcagtgaaatacaaagaaggcagtaatgcaggaaatgatggacaaaaatgtataaagcatatagaaaacaaatagcaaaatgacagaagtatatatcaataaatgctttaaacttaaatgcgttaaactcttcaaccaaaagacagagattggcagaatggattagaaaaacatgattcacttatatcctgtctacaggaggctcactttagatccagagacacaaatagattgaaagtgaaaggattgaaaaagatactccatgcaatagtaaccaaaagagagcaagagtggctatactgttatcagacaaaataggctttaaatcaaaatgttgtaagagacaaagaaggacattatatattaataaatggttcaatacagcaagaggacacaacaattaaaatctgacatatgccacaacatggatgaatcttcagaacattatgctgagataagtctgtcacagaaagacaaatactatatggttctacttatgcagtatagagtgtagtcaaaaatcatagagacaggaagtagtatggtggttgccaggggtgcagtggaggatagaatgcggaattagtatttaatgggtaaacagtttcattttggtgtaataaaaatgttttgaatagtgatgatggttgcatgatggtgtgaatgtatttagtactactgaactgtacacttaaaaatgattaatatgttaactttatgttatgtgtattttacaactatgacagtctattttgtgctgctgtaacagaaaacctgagattaggtcatttataatgaatggaaatatatttctcacagttttagaactgggaagtccaagtcagggactggcatctggcaagggccttcttgctgcattgtcccatggcaaaagggcaaagagaggtcaagggaaaggaaaggggatcaaattcattttttatgagaaacctacttctgagacagtagcattaaatcattcataagggcacagccctcatgggctaatcacctcttaaaggtatcacctcttaatacaattacaatgggaattaaacttcaacgtaactttgggaggggataaatattaaaaacatagcaatcacaataaaactgggaaattaaaaaaaaattgtgcggctgggagcggtggctcacgcctataatcccagcactttgggaggctgaggcaggtggatcacctgaggtcaggagttggagaccaacctggccaaaattgtgaaatcctgtctctactaaaaatacaaaaattagccatgcatggtggcatgtgcctgtaattccagctacttgggaggcagagacaggaaaattgcttgaatctgggaggcggacgttgcagtagagccgagatcacgccactgcactccagcctgggtgacagaacaagactgtgtctcaaaaaaaaaaaattgtgcaactatcatcaatatataattccagaacatttttatcaccccaaaggaaacccatattcattagcagttacttttctgcttagcccctggcaaccactaaatgactaaaaataaaagctgaagctatgataggaatgtcttattctaattttggtaatattcattatattttaagtagacagatgtaaataatgggcaaataatgcttttaattattttctttaacccgtcttagagccaagaagcttctttcaaggcagtggtacatggtggaggctatcagagtttctagaataattatctaggctgaaagtcatatctgggctttttggtgatctttctatgtgagcacgtacagctaatttgactaattctcttcaaatatttcttgaagatgtatgttacaacaaggcttaggttataatattagaataggccttctcttttgagtggagtaatatgattattctaataaagatcctttcttcactgaggctactgtttgggagttgaagtaactgggaaatttgaacctacccttctcctttcacattatatcaccagtataagagcagaattgtcagatattccgttaaatattggatacgaaatgttttttaattgataaataatttgtgtgtggcagtatttctgcattcttgtcctataaactaatatcagagttctttggttgctgtgacatgcctcctcagattaatagtgagatttcttcctgtaggtaaccctaatttcttttaaagcaatgatttatggtattatgatctaaatgccttttttttttaagagatgggatctcaccatgttgcccaggctgagctcaagctatcctcccacctcaccttggcttcccaaagtgctgggattacaggcatgagccaccatacccggccctcgatgcatttttaatgttacattagttgctaaaaaataaaacataaaaaagaggccgggcacagtggatcacgcctgtaattccagcactttgagaggcgaggtgggcagatcacctgaggtcgggagttcaagagcagcctgaccaacatagagaaaccccatctctactaaaaatacaaaattagcccagcgtggtggtgcatgcctgtaatcccagctacctgagaggctgaggcagggaaattgcttgaacctgggaggcagaggttgtggtgagccgagatcacgctattgcactcccctgggcaacaagagcaaaacttcatttcaaaaaaaaaaaaaaaagaatattttgcaatatcagggggcaataatgtgatatgctggatagtaaaaagttaatgaggacatagatgcctagtctaagcaaaatagataagaagttgctgatcgtaattgatgagaatgacgtcacagtggaatagcagataatgcatgagtggtgaatttcctcgtttagtcttactttgaggcagcaaataaatcctttataagtgttgcattacttttatggtgtgtgtgtgtgtgtgtgtgtgtgtgtgacagagagagaggcttcaatccttaaatcatgtaatattaagaaaaaacaaatgaattcacttagaagatttggggctggatctatattttttcatcattttaacatttgggggttaaaatttccagaccgttggagacgacatccatccagaacagagtagatcctggagattctggataaattatctgcaagtgcatttttttttcccaatagattgagtttattatcaacattcagtttgctgattaaaaaatttttcagtatatcgatattgaactcgagttggaagaggcgagtctggtctcaaaatggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccgtgaaaggggacagttctggtggaagaagctcgggcagtccctatggtggtggttatggatctggtggtggaagtggtggatatggtagcagaaggttcgaaaaacagcagaaaagggctacagttcttagtaggagagagagcgaggagttgtcaggaaaactgcagcttactttgagacagtcctcccaaatgcattagaggaactgtaaaaatctgccacagaaggaacgatgatccatagtcagaaaagttattgcagcttaaacaggaaacccttcttgttcaggactgtcatagccacagtttgcaaaaagtgcagttattgattaatgcaatgtagtgtcaattagatgtacattcctgaggtcttttatctgttgtagctttgtctttttctttttcttttcattacatcaagtatattgccctgtaaattgtggtagtggtaccaggaatgaaaaataaaggaatttttaacttttcaaaagaaaaatttttcagtatatctgcataaatgaaattggtccatcatgtgtattagaggaagctatccttactccgtttgttatcaggattatgttagcttgaagaatggactgataaactttctataaggcttattacaggctttaacctgtaaaattgatctcatcgtaaacagctttgagagtatacagatagttgactatttttcttctctggtttcttcagatactcttcatcatcttggatttgttttaataatttatatatgttaaagaaaataatcaaaactgtgcagatttataaatctttaaaattgtacacaatattatatattttaaaactccctacatatgcagttttatcacccttctcatttatggtacaccataagactcactttttgatgccaagtgttctcgaaaatgtcctaaggaagatcattgctggaacaatgttatttttgagacttttgttccttataaggaaatagacatcaattaaggagggaattttttttttggaggtggaaatgggtagtatgatcaagcaactatatgtatatttccctggggaacacggcattaagaagagaaaataatcccaactattaacaatttcatctgtgcagtggtttttattctgcaacattgtcttttctatttttgtacatgttttctagaaaaggtaaacatgtagtagaaataaatgtgatgttaattgctatggcagtgtgtctgtacacattacttttttctcctgtctacccaccttccattggcaatcacccaactggttaggtaaatgagggtggatggataataaacgtttcttcacaattacttccttagctctcaaaagggattctgaagcattccattataagtgctgcttacagacatgctgaaatgaccactttttgctctggagtgatattctttgcttaataaagaacaagagatcacaatatctttctttcctgagcagaagcagggcaaactgttgattcctttttgtttttttcctgcaaagaaaggaccttgcttatgtcacccaatttcccctttcaggaaggggaagtaatttttagtaagtcaaggtatgtagtagccataaggtcttctgtttaggattaaggttcagtgaagtcatttggcattcatttatttttggagttttgatccgaaagctgcttcattgcagaattttagtctgaattatgttctaaagattgatgatctctctatgggacttcactgtaactactccattaggacatcagatttagccaagtatttatgtgttaattttgttggattaacttatgtgcatagacatacacacacacacacacacacacacacacacacactgaagcctcattgttcccttaaattttaatttttatttgatatcttttcataatctattgagaaaagttatgatgggaatgcagtactgtgagtttgcactgacaataaaggttgatctatgacagcctcttagaagcaactactttaaaatattttatagtgggaaaaaaccccacaaatgcagttgttgttttgtatacttttttctctgttgacctgaataggattaaataacctctagggtgatttgcccattcagcaaagtggcacaggccaaaaaggagattaaagtaggatgagggggaaacaaggaaaacatgacaaaggaaaacccaagattagaaagactcagtgaagaaattttactcaaagaaataaagaggttttttcttccttcagtatccccaaagcaatatagcaggaaatcttactttgattatccatcaacaagcaagagtggaattaataagttgaccagcaaattgatacattccactgtgcacgcaaaagtcagacccttataagtaagcagttgcatgatatactttataagtatataagcacatatgttacaagttcttcatgggaaagcagaccagctcagcctagcctgaatgccacctagtgttctcttgtatgtataggatacaagtggagccaatggttgattaattgaaaatgacaattaagatagggaattacataaattgatataaattttcatgagcatttgatttttaacttaaagcatatactgactggagactgctgtcatctttcttgcataaacaacatataatgcttgtctcctgtttccaattcaaatttccataaagtagaacaagagcttagcaaactgagtatggaatcctactcgatttttatattttttataacaatttttcttttctaacattttgagatttacctttccaaagctttcagtgttttcccaaaacatttatctgttttcatagaaacaccctttttgtactcatatttcataatatttaattaaatattaaattgcataatcacaaattggcataaaagcagtgagaatgaacataacttggtaaaacagaatgtgaagacatactgctattggagtagtctgtttgatttagcttgcctgtgggcagctgcatgttttaaacaggaaatgtagagctagcccttacatagtggagatagcccatttggggagtttctgctctgtttgatttggctgatgcctgtattcttctttagggataattagctatgataggcctttatggctaagactttaaacaataatacttggtgaagtgagttgtcaaggagctaaatatacacattagtatgagaagagagcaacacgcaatctgatttcagagctggtgcacttaaccatcatgctatctactgcttccccttgtgggaagtattagcatgccactttatgtccataatatagcaagtagataagaaatggtgcataggaaataatataattatgctgacccttttctatattaaacattattctcaaaaaacagagcatatacctcagatatctctagaagagttaccaaaactgatcttctattaggttaacagtatgccactaaatgagtaagaacaggaattatgcaagccatttatgtagatgaaattcaaatagaattataaataacaaaactgaaaaagccatttggttgataattattatttgggatgcatattttgcttgttttaaattagttttcagggtcttcttcctttaggggtagcttagctcagtctttagcctgattcagttcaagagaagaaaggctaactactttttacccataagaggcagtgcagcttactctctggagtcaagctaacaagtatgacctgtccgtacattttaatttcacttagtagctgtgtgacctcgggcaaattaccttacctctcttgtctcagttacctcattataaaatagggattagtatctattacacagaatttcttttatttatttattttattatactttaagttctgggatacatgtgcagaatgtgcaggtttgttacataggtatatacatgtcatggtggtttgctgcacccatcaacccatctctacattaggtatttctcctaatgctatccctcccctagccccccatccctcgacaggccccggtgtatgatgttcccctccctgtctctatgtgttctcattgttcaactcccacttatgagtgagaacatgcggtatttggttttctgttcttgtattacacagaatttcaatgagaattaaatggattcatgtgaagttcttacaacagtgcctggtgtatagtaaatgctcagtaaatgatagtcatcatcatccttatcaaccttgaaaaagggaaatagtgatattattgttgaaaatatagccagaaacatgaatctgaagtatgtagtattggagattaggtacagaataaacaagaagtagaaccagagaaggcatacgtgaaaaattaatgtgtggtccagaatagatgtcatagttctgggcattacctcttgttcattaaaagataaatagtgggtcagggtagaaataaaaaaataagctggaggaaggaaataataaaaatgacatagaaatacagtaggataaattcgagagtggactttctgaaaaatcccaataatatatgagtacctacagcaaatctaattggaaaagaaaaagaacgggggaaatcatttaaaaagttaaaaagaggatcagggagagatcctaaatagtgtgagagactgctatgcagagttgtgtggtaatatatttggaaatcttgatgaaatctaaaatttcctagcagatataaaaatcagctagagaaatagaagactgtgattatgtcattcttctgcttgaaattcccctaaatagcttcccattgttctcaagataaagatagatactttcaacttgtcttccagtcctccctgatctgacctgtttcttgccatccaggccttgcattcttttcccttgggctcctgcactctggccatattgatcttctttctgttcatctaatactgttctcttttgcaccaggacctttgcacgtcctgtttgttttgtgtgttttgaacacttaatttctattaatccttagatttctactcaagtttcatgtcatggggaaactgaaccttactcttcacagactaggtttgggtccctgtgccatctgctctcatagctccttatactttgttttcatacttaacactattaacaattatttctgggtatttatgtctctttctccccaagtatatcataatttctttgatggtagaattgatggctgttttgcttattcttgcctagcacagagagaggtactcagtattttctgattaaataaggacttgcatagtcaaataacctcttccgttttttcttttttctctctcttttttttttggagatggagtcttgctctgtcgcccaggctggagtgcagtggcatgatctcggctcattgcaagctctgcctcccgggttcacgccattctcctgcctcagcctcccgagtagctgggactacaggcgcccgccaccacgcccggctaatttttttttttttttttttttgtatttttagtagagacaggatttcaccatgttaaccaggatgttcttgatctcctgacctcgtgatccgcccacctcagcctcccaaagtgctgggattacaggcgtgagccaccacgcccggccccattttttctttaatagtgagatttagaaacccatcctctctctctctccctctcaaacataaaaaacaacctaagttgtttcacagacacattcttgtaagctttctaggaaataattttctatatccaactgttttgtaacatacccatatacatatagaaagctatccagttcattttatttcaatctcaaatttgataaagtaccaaaaagtagtaatacagacctagttcagtcatgaatatggatgggaaaagtcaatataaaattctagcaaatcagattcagcaggatattaaaagaacatttcataacataagttatacattgaatttaaaaagtaggtgaatattagattaaaaatgaaaaaccacatggtgatcttaatgccacaaaagagtttgataaaactcaatattcattctttataaaagtatttaatggtttggatgaagacttcttcagttaaagaaaaacaaagaagaatttctgtccaaaccaatatcccagtatcttgctatataatgaaatgatagagtcatttctatgaaaataggataaaataaagaggcttgcggatacagccttttttttttttttccaagttctagacaatgcaataaaacataacagaaattagaagcagggcttttggaaaaaaggagatacagttcccatttatttgcaggccgattggttatatctagaaaccaaagagaaaattaaaaacttttggaattagtaagaataggtatgaattaatatgagagttgagttggatacacatgtttttgagctgattcatgcaaaggctttccaagctcctttgtgttttactaggttgtgtttgcttaaagttggctcgctagtacgcagtcatgagtcaggggaagagaaggagcctgactggctcctatattgttctgagtcatatttctttttttcagtggaattaaaccaacatgattgttgaaagagatcaaaatttggcaggttttcatttgcttgatatctgtaaacagacttttctttcaggaaaggaatttggaggagggcagagccatcattatctcttttttacaaatctacaatttcccatttgacccttacaattaatctgaaagtcaatttgtgtttgagattatacgacagtaacaggttgataagcagacatttctatgtcttattcgataagaaatactgaattaagttggagaatggaggtcatgtgctgccccgtacatttctcatcttgtcctcagcaaggactatatggtaattttcatagattttgtcaattaaatgaccgatatttgagtaccttttaagtgctagttcctgttcttggtggtaggattgcagtggtgaagaagatatattctgttcttaagaggattacattgcagaggggatagatagataataagctgtgtataaataagataaatttaattataaataatactgataaatatagagaagataaaataggtattgaccaattatgaatggcatactgtatggcaagagctttttagatggagtcaaagaagtctttgctgaaaaggtgacatttgaattgagtcatgaaggatgaggaagaggaagccatgagggcacctgttctaagagcatttcccagcataaagaactatgtggtgacaataaattcagggacagaaaggaggccaatgtggctgaagaacagtgaactaagtgggagagtaagaagaggtaatgctggagaagtagccaaaaaccaggtcacgtaggaacttgtgggccataagaaggagtttggatttttggaaatgtgttggaaaacctttagattgtttgtttgtttttcaaagtgagatgtttatgatctgtgtggaagacagacaagaagaaaacaaaagtggaagtagaaagaccaggtaggacatcgttgcttgtgctggtggcttgggtccaggtgggtgcaatggagattcagggcagcaagtagaatttgactgatggattggagtggtatgaaagaaagagtcaaggatggccctaattttttgatctgaataataaagtgtataatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctcaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaagaaaaaaaaaaaagaaaaccccataggctcagcttgaaaactcctccagctgatacacagcttcagcaaagttgcaggatacaaaatcaatgtacaaaaatttactagcattcctatacaccaacaacagccaaactgagagccaaatcagaaaggcaatcgaattcccagttgccacaaaaagaataaaatacctgggactacagctagccagggaggtgaaagatctctacaatgaaaattacaaaacactcctcaaataaatcagagaagacataaacaaatggaaaagcattccatgctcatggataggaagaccccatatcattaaaatggctatattgcctaaagcaatgtacagattcaatgctatttctatcaaactaccaacagcattattcacagaactagaaaaaactagtttaaaacccttacggaaccaaaaaagagcctgaatagccaagggaatcctaagcaaaaagaacaagtgccagaggcatcatgttacccaacttccaactatactacaaggttacagtcaccagaacagcatggtacaggtacaaaaacaggcacatagaccaatggaacagaagagagagcctagaaatcaggccacgcatctgatcatcaacaatgctgacaaaaacaagcaatggggaaaagactccctattcaataaatggtgctgggataactggctagccatatgcagaagattgaagctggatcccttccttgcaccatatataaaaatcaactcaagatggatcaaaggcttaaatgtaaaattcaaaactataaaaaccctggaagacaaccaaggcaataccatcctggacatagaaccggcaaagattttatgacaaagacaccaaaagcaatcacaacaaaagcaaaaattgacaagtgagatctaattaaacttaagagcttctgcatagcaaaagaaactatcaacagaataaacagccaatctacagaatgggagaaaatatttacaaactatgcatctgacaaaggtctaatattcagcatctataaagaacttaagtaaatttaggggagaaaaccccatttaaaaagtgggcaaaggacatgaacagacacttcccaaaagaagacatacatgaggccaacaagcatatgaaaaaaatcttaatatcactgatcattagagaaatgcaaattaaaatcacagtgagataccatctcataccagtcagaatggttatcattagtcaaaaaataacatgctggtgagattgcagagaaaaggaaacacttatacactgttggtgggagtgtaagttagttcaagcattgtggaaagctgtatgatgattcctcagagacctaaaagcagaactgccatttgacccagcaatcccattactgggtatatacccagaccaatataaatcattctactgtaaagacacatccatgtgaatgtttattgcagcactattcacaatagcaaagatgtggaatcaacctaaatgccctcagtgacagattggataaagaaaatgtggcacctaaataccatggaatactatgcagccataaaagaatgaaatcatgtcttttgtgagaacatggatggagctggaggctattatccttaacaaactaatgcaggaacagaaaaccaaatactgcatgttcacacttacaagtgggagctaaatgataagaacctacaaacgaagaaaacaacagacactgggggctacttgatggggagggtgaaaggagcaagaggcgcagaaaatataactattgggaactgggcttaatacctgggtgatgagataatatgtacaacagacccccttgacacatgtttacctatgtaacaaaccttcacttctacccccaaacctaaaataaaaggtgaaaaacaaaagatgaggcaatactttgagtaatgcaataagaaaactgaaggagggtatagtagtacagcatccttttaggcaattctattattcttacaattttagatttttaaaaatatagttgggaataactgataaataatgatgaaataattttcaggatgatggattaccgaaagatttaaggtataggaaaaataagatcactgaggccctgtaatatatcttagatttatgaaagagtccaatggacccatatggtaattgcaagacaaaatgagtgtgttttaaaaacaagtaagagttctgtttgctcttgaatacctctaagaaagaataaattcatgaaatatcaatccttacaaatagaactgcccagaaacaaatttaaaaaacaaatctccagtctagtggtcccagataataccaagggataagtttgaagtgtgtattaaatatcccattggagatgtagagtagtggttgtctccagaaatctaaacctcagaagagaggtctagactagaggtttcagtctgagagtcatcaaccatttgaagctttggatctagatgagatcacccaggaaagagaggataaatggaaagagaagagggccaagaatagagccctgtggcacactagattttagaaatctcatttaggagaaagatactgagagggtgcaaccagtgaggtagaaacctgtgatataacttggagaatagtgttttaggtggggagaagtcaactggatcaaaagataagagtaatttttaaaaaagtaaggtcagagaagtttgatcattgacttttttaagaatagggatctttgatgacccttaggagagctgtttcattgaagtgatgaggctgaaagcctgtttgtgatggattaaaatgaggaagtagagataagcaatagaggcaaattttacaataaattttgctgtgaaggcgggggagagatggtatttggtgagagtttcttttaacccactttagaggattgagaggaattggtagagtacctggaattggggatgtcaatcagggagatattggtaccttaaattaacatattaaggcttgacattaatactctcacattaatactgtatagaatagagcagaattcttctctctccttttctcttttatggatgtataatagaggtacatagtttaggggtacatgtgaaaatatattcctataacttacagagatcaaatcagtgttcttgggatattcatcaccttaaatatttgtcttttctttatgctataaacattcaaattatgctagctatttcaaaatgtacaatagattaagttatagtcaccctactcaccctactgatctatcaaagagtaggtcttatttcttctatcaaaccatatatttgtacctattaatcaactcctcttcatctcttccttgcccatatacttcctggcctctgttaaccaccaatctactgtatctttatgagatccacttttttggctcccacatatgagtgagaacaagcaatatttgtcttttactgcttggattatttcttgacataattacctcccgtttcatccacattgctacaaatgacaggatttccttcttttttgtagctgaacattattccattgtgtatacatactacattttctttatccattcatctgttaatgagcacttaggttgatttatatcttggcagttgtaaatagtgctgcaataaacatgagagtgcggatatatctttgatatattggtttactttcatttggatatatacccagtagtggaatggcttgatcatatggtagttctattttttatttcttcaggaacttctatactattctgtgtagtgattgtatttatttacattcccaccaacaatgtataagggttcccctttgtttccatcctcaccagcattgttattgtctgtctttttgataaaaggcattttaactagggtgagatggtatctcattgtggtttttatttgcatttttctgatgattactaacaaggagcatttgctcacttacctgttggccatttgtatgttttattttcgggaatgtctgtttagatcttttgcccgtttttaaatcagattctttggctttttgctgttgtgttgtttgcgctccataaatattctgattattaatcccttgtcatatggataatttgcaaagattttctctcattctgtgggttgtctctttgctttgtggttgtttcctttgctgtccagagcttttagcttgatataatcccatttgtctatttttgctgtgtggccttgtgctttcgacatcctacacagaaaatcttggcccaggtcagtgtcctggagcatctccccagtgttttcttctagtagtttttcttcagttgttcgaggtcttagatttaagtattttatccattttgctttgatttttgtgtttggtgagagatagtggtatagtttcattcttctgcatatggttaatccagtttccccagcagcatctactgaaaatactgtcttttccccattgtatgttcttggtacctttgtcgaagatgagttggctgtaaatgcttgtatttatatctgtgttctttattctgttccattggtctatgtgtctgtttttataccagtaccatgctgatttggttactatagctttgtagtaaagtttgaagtcatgtagtgtgacccttccagcttcattctttttgcccagcattcctttggctatttggggtcttttgtgattccatataaatgttaagtttttttttctatttttgtgaagagtgttactggtattttgttagaaatagcattgaatctatagattgcttagggtagtatggacatagtaacaatattaattcttctaatcaataaacatggaatatctttcaatttttttggcatcctcttcagtatctttcatcagtgttacatagttttcaacatagagatctttcagttctttggttgattcccaggattttatattcattgtagctattgtagatgggattgctttcttgatttctttttcactttgtttgctgttggtgggtataaaggctactgatttttgtatgttgagtttgtattttgcaattttactgaatttgtttatctgttctaatagtttttttggtagaatctttaggtttttctgagtataagatcatgttgtctgcaaacaagactaatttgacttcttttccaacttgaatgtatgtcctttatttctcttgcctaattgctttggccaagacttccaagattaagtggtatacaagtggtgaaaatggatatccttgtcttgtttcagatcttagaggaaagatcttcaatatttcacctttgagtgcagtgttagctgggagtttgtcatatatggcctttattattttgagatatgttccttttataccctttgtgatgaggattttatcataaagggatgttgaattttatcaaatgcttatttaatctgttgaaataatcatagggtttttgtattggttctgttaattatcgcatttattgatttgcatacattgaaccatctttgcatccctgggatgaatcccacttaatcatggtgaatgatctttttaatgtgctggtgaatttggtttgctagtattttgttgaggatttttgcatctatgttcatcagtgatattggcctgtagtcttctttttttgttgtgtccttatctgtttttggtatcagggtaatgctggcctcataaaaggagtttggatatattccctctggttcaattttttgagtagaattgatatttgtttgtccttaaatggttggtagaatcatcaatagagccataaggttccacacttttctttgatgggagacttttgattacagcttcaattgtgttacttgttattggtttgttgaggttttctgtttcttcatgggtcaatattggtaggttttatatgtgcaagaatttactcatttcttgtaggtttttcaatttgttggcatatagtctctaatgattctatttctgtggtctgagttgttacatcttttcatttctgattttatttgggtcttttttttcttagtctagttaaagatttgtcaattttgtttatcttttacaaaaccaactttttgtttcattgatcttctgtattgttttttaagtttcaatttcatttatttctgctctaatcattattatttgtttccttatagtaattttgggtttgatttctttttgcttttctagtcccttaagatgtatcattaggttgtttatttgaagtctttctactttttggatatagatgtttattgctataaacttccctcttaatactgcttttgttgtatcccatacgttttgttatgttgtatttccattttatttatttcaagaaattttaaaattttttcttcttaatttcttcattgatcctttggtcattccagagcatattgtttaatttccatgtgtttgtgcagtttctgaggttcctcttgttattgatttttagttttattacattgtggtcagaaaagatacttgatatgatttctacttttctaaatttgttcagagttgttttgtggcctaagatatggtctcttctggagaatgttccatgtgctgatgagaagaatgtattctgcttgtgttggtgaaatgttctgttagttagacctagtgtgtagtttaactctgatgtttctttgttggttttctctctgaatgatctattactgagagtagggtgttaaaagttccctactattttttctttttagagacagtgtttcactctgtcactcaggctggagcacagtggtatggtcatagctctctgcagcttcaacctcctgggttcgagtgatcctcctgcctcagcctcccaagtagctgggattacaggtgcatgccaccacatatggctaatttttaaactttttaagtagagacagggccttgttatgttgcccaggctggtcttgacctcctggcttcaagcagtcctcctgtcctggcctcccaacatgctgagattgcaggcataagccatcacacctggctccctcctattattgtattgcagtccatctttccctctagatctattaatatttgcatatatacttcagagctccactgttgtatataaatatttataattgctatatcctcttgctaaaatgacctttctcattatgtagtgaccttgtctctttttatagtctttgatttgtagtttattgtatctgatataagtatagctattcttgttctattttggtttccagttgtatgaaatatcttttccacccttccactttctgtctttgtgtttctttataggtgctaagtttcttataggtggcataaagttgaattgtttctttatctgttcagccagtctttgccttttaattggagaattgagttcatttacattcagtgttattattaatatatagtgacttagtactaccattttgttgcttgtttgtaattcctctcttccttttttactgtcttcctttgtggttattttctttggtagaatgttttaattcattgctttttatttttggtgaatctattacaggttttttgcattgtggtcaccatgaggcttacacaaaacatcttataacaaggtattttaaagagatgacaacttatcttagatcacaaagaactgaagttttaattttatttaatataagttaaatgtaagtagccacacgtgatgagtggatactgtattggacaggacagctcaccacttttatcatgtgccagtaggtgaagaagggaagaattgggtagatcagagtttttccggtagcatctgcattgagatatgccgtaagtgtaaaacacatgctgaatttcaaagatataaaaaagaatgaatttgtcgtcaataattttaattattgattacccattgcaatgatgtaatatgaatatatttggttaaataaattattaaaataatttcacctattttattttatatttatgtaaccactagaaaatttaaaattctacatgtggctcacatttgtagatctcgtatttctataggacagtgctattctgacagtgagctccttatggggaaggacccttttcattttaatcttgactattactgtgtctttaatatagtagatacttaatagttgttgaatgaataacatagtctctagaaattgtgaccataagccttttgaagaattgaggctttgaattaaagcatatatatgatagatacatacataaacacacttgcacatacaggaagaaacctacatctaggaatacaagagtaatagcacttgttttgagccaaattctattaataattgaagaattaagttctcataacagcatctgtaagcaaaattctattaatattcctcatttacaggaaacagagacagggacattaagtaacaaaatgacacagaaatattaagtgatagaaataatttgaattcaggcagtctggctgtgtagtttgtacctttaaccagtatgctaaagaaatgtcatgtaattttggtcatccataattatcactttcaaaattgtgaaaggaggtgtatgaatgaatcctgggcagttttggacttgggggactttttgatgcctcttttgctttcctggaatgaagaaagtttacttaggccttacaatctgcttttaattgctttaagatttattaaagttcagcaagcaaagtctttttttttttctgttcggcatcagcttttatgtttatacttccagtaatatttttttcagctctgggaaaagtataaagaaagtgttgccactggtagtgtatgagtgaaaaattatcatttgacttttgggaaaatgaaatggttatttatatagtggtcccaagaatcaacttatctcttatattattaataggagagatttctgcttggtaatagatttataatactttactttttgggatgaagcaaaaaggcaagaatataagtttatttcccttcagctttctgttaacatttcccacagaaagttttatttcatatctaattgtaaatccagtatgttattattctgaataaatcttttataaataaatagttataaaacaggagggtataaggttcaaaggaaaagatgtattctttttcatttttaacatgctgccacaatttcccatatatgctaagtttatctgttttttctgtttacgtgattcttttcagtagtggcataccttttgctaattcacacacatttgtaagggtattcaggaaaacttagcttaaaaaatatgccatcaaaagattggagatggattctaggtagaaaaatgaatttatctgtaggcattatcatgttgcatgcagaaaatagtctttttttttttctctcttgcttgctcagtctgagctgacaggcagttctgaatattgggcagctctgtttcacactgccatccagggaccttgttttgtttcttctctcttgttctaccattccctaaggtgttgcatgtctgcagagatgagtctgaattgccaccaccaccacattcgcattctagtttgtgggaaaaggggaaaaaaacaagtggaaagcaagcagctttcaaaaaagtatgaagtttagaaaacttcacagttacacacaacacttcatgctataacctattgaccagaacttaatcacgtggacacatctatctgcaaatgtggccatcacctcacatggtaactatattaaaaaaaaattgagaacatttaagatctactcacttagcaaattttaagtttacaatgcagaattattaactatggtcaccatgctgtccattagatttctataatttattcattgtataactgaaacttagaatcctgtaaacaacatctccccatttcctcatcccctgatctcactcagtcccttacaaccaccattctactctctgcttctgagtttgaaaatattccatatataagtgagatggagtatttgtatttctatgctaggcttatttcactgagtataataccctctaggctcattcatgttgtttcaaatgacaggaatttcttctttttaaaagccaaataataatccatagtatatagccttttagtttgatgcaaagctatttgttcatttttgcttttgttgtgtgtgctttgagcatcatatccaaaaaactcattgcccagaccaatgtaaaaaagcttttccctgtgttttcttctggtaatcttacaggtcttacatttacgtctttagtccatttgagttggtttttgtttatggtctgaaatgagggtctaatactacagaccaaatggacctaccagatatataaataacattccagctgacagcagaaaatacattcttttgaagagcacatggaacattttccaggagggatcatgtgttagggcacaaaacaagttttaacaaattcaagaagattgaaatcatatcaaatattttcagccacaatggtatgaacctagaatcactaacaggaagaaaattgaaaaactcacaaatatgtggaaattaaacaacatactcctgaacaaccagtgggtcaatggagaaatcaaaatgaaaatttttaaaaattgtaaagaaaaatggaaacacaacataccaaaacttaagggatgcagcagaagcctttctaaaagggaagttcatagcagtaaacacctacatcaaaaaagactacaggaagacctgcttgaggctgttttacagttaccattttttttaacaaggagaaggagtacactctaaaaacaatgataaaagtataatatagtagatacataaaccagtaacatagtttttattatcattatcaagtattatttactgaatataattgtatgtgctatacttttatatgactggcaatacattaggttttttttataccagcatcaccacaaacaccttagtaatgtattacaatgtctacaacatcattaggctataggaattcttcagctccattataatcttatgggaccactgttgtatatgtagtctgttgttgactaaaacattattatgcacttcatgactatattgcattgctgtttctcctttcacttctgttaatacgtgctttgtttattaatatttagatgttctggtccatatgttgggtgcatatatttttacagttgttatatccttttgatgaattgactcctttattattacataatgacttttgtctcttgtgatagtttttgactgaaagtctattttgtctgacgtaagaatagctacctctgttctcttttagttaccatttgcttggaatatcttttcccatttcttcactttcagcctgtatgtgtgcttaaagctaaagttccttgtaggcagcatatagatagatcttgttttttttttttttttgagacagagtctcgctctgtcacccaggctggagtgcagtggcgcgatctcggctcactgcaagctccgcctcccgggttcacgccattctcccgcctcagcctcccaagtagctgggactacaggcacctgccaccacgcccggctaattttttgtatttttagtagagatggggtttcaccgtgttagccaggatggagatcttgtttttttaagccttcaaccattctgtcttttagttggagaatttaatccctttacatttaaaataattgttgataggtaagtacttaccattgctgttttgttaatttttttctgaatgttttgtagtttgtttcctcctctctttctaccttcctttggaatttgatagttttttttttaataatgatatgctctgattccttcttctttatgttattgtgtatctactacaggtgtgtgtgtgtgtgtgtatgtgtgtgtgtgtatttaccatgaggcttactgatattgtgtatctactacagttgtgtgtgtgtgtgtgtgtgtgtgtatttaccatgaggcttactgaatacatcttataacagtctattttaaactgataacaacttgacttcaaatacctacaaaaactttacactttaacttttgctcccaccacattttatgtaattgatgtcacagtttacatcttttgtattgtatatctattaacaaattattatagctaagttgttttaatacattttaaacttttatagtagagttgaaagcgatttacacaccactattacggtattagcatattctgaatttgaatttatagtaactttttaaaattcatgtattttcatgttgtcaattagcattctttcattttaagttgaagaactcactttagcatttcttgtaaggcaggttcagtgattacaaactccctcagcttttgtttttctaggaaagtctttatctctcctttatttctgaaggacacctttgctaggtatagtattcttggttgacacatttttttttcttccagtactttatttatttatttttttattatactttaagttctagagtacatgtgcacaacgtgcaggtttgatacataggtatacatgtgccatgttggtttgctgcaccgatcaactaactcatcatttacattaggtatttctcctaatgctatccctcccccagcccccccaccccctgacaggccccagtttgtgatgctctctgccctgtgtccaagtgatctcattgttcaattcccacctatgagtgagaacatgcagtgtttggttttctgtccttgtgatagtttgctgagaatgatggtttccagcttcatccatgtccctgcaaaggacatgaactcatcctttttttatgactgcatggtattccatggtgtatatgtgccacattttcttgatccagtctatcatcgatggacatttgggttggttccaagtctttgctattgtgaatagtactgcaataaacatatgtgtgcatgtgtctttatagcagcatgatttataatcctttgggtatatacccagtaatgggatggctgagtcaaatggtaattctagttccagatccttgaggaatcgccacactgtcttccacaatggttgaactaatttacattcccacttacagtataaaagcattcgtatttcttcacatcctctccaccatctgttgtttcctgaatttttaatgattgccattctaactggtgtgagatggtatctcactgtgattttgatttgcatttctctgatgaccagtgatgatgagcattttttcatgtgtctgttgggtgcatagatgtcttcttttgagacgtgtctgttcttatcctttgcccactttttgatggggttgtttttttcttgtaaatttgtttgagttcattgtagattctggatattagccatttgtcagatgggtagatcgcaaaaattttctcccattctgtaggttgcctgttcactctgatggtagtttcttttgccacgcagaagctctttagtttaattagatcccatttgtctattttggcttttgttgccattgcttttgatgttttagtcatgaagtccttacccatgcttatgttatgaatggtattgcctaggttttcttctagggtttttatggttttaggtctaacatttaagtctttaatccatcttgaattaatttttgtataaggtgtaaggaagggatccagtttcagctttctgtatatggctagccagttttcccagcaccatttattacatagggaatcctatccccatttcttgtttttgtcaggtttgtcaaagatccgatggttgcggatgtgtggtgttatttctgagggctctgttctgttccattggtctatatatctgttttggtaccagtaccatgctgttttggttaagtcaggtagcgtgatgcctccagctttgttctttttgcttaggattgtcttggtactgtgggctcttttttggttccatatgaagtttaaagtagttttttccaattctgtgaagaaagtcattggtagcttgatggggatggcattgaatctataaattatttgggcaatatggccattttcacaatatggattcttcctatctatgagcatggaatattcttccatttgtttgtgtcctcttttatttccttgagcagtggtttgtagttctccttgaagaggtccttcacatcccttgtaggttggattcctaggtattttattctctttgtagcaattgtgaatgggagttcactcatgatttggctctgtttgtctgttaatgatgtataggaatgcttgtgatttttgcacattgattttgtatcctgagactttgctgaagttgcttatcagcttaagaagattttgggttgagacagtggggttttctaaatatataatcatgtcatctgcaaagagggacaatttaacttcctcatttctgaaccgaataccctttatttctttctcttgcctgattgccccagccagaacttccaacactgtgtcgaataggagtggtgagagagggcatccctgtcttgtgccagttttcaaagggaacacttccagtttttccccattcagtatgatattggttgtgggtttgttataaatagatcttattattttgagatacgttccatgaatacctaatttattgagagtttttagcatgaagggctgttgaattttgtcgaaggccttcatctattgagataatcatgtggttttgtcgttggttctgtttatgtgatggattacatttattgatttgcttatgttgaaccagccttgaatcccagggatgaagcttacttgatcgttgtggataagctttttcatgtgctgctgggttcagtttgtcagtattttattgaggattttcgcatcaatacagggatattggtctaaaattctctttttttgttgtgtctctgccaggctttggtattaggatcatgctggcctcataaaatgagttagggaggatttgctctttttctattgattggaatagtttcagaaggaatggtagcagctcctctttgtacctctggtagaattcggctgtgaatccctctgattctggactttttttggttggtaggctattaatttttgcctcaatttcagagtctgttattggtctattcagagattcaccttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcactttttattgcatctatttgattctttttttctttattagtcttgctagcagtctatcagttttgttgatcttttcaaaaaaccagcttctagattcattgatttttttgaagggttttttgtgtctccatctctttcacttctgctctgatcttagttatttcttgccttctgctagcttttcaatatgtttgctcttgcttctctagttcttttaattgtgatgttagggtgtcaattttagatctttcctgctttctcttgtgggcatttagtgctataaatttccctctacacactgctttaaatgtgtcccagagattctggtaagttgtatctttgttctcattggtttcaaagaacatctttctttctgccttcattttgttatttacccagtagtcattcaggagcaagttgttcagtttccatgaagttgtgcagttttgagtgagtttcttaatcctgagttctaatttgatttcgctgtggtttgagagacagtttgttgtgatttctgttcttttacatttgctgaggagagctttacttccaattatgtggtcagttttagaataagtgtgatgtggtgctaacaagaatgtatattctgttgatttgggatggagagttctgtagatgtctattaggtctgtttgttgcagagctgagttcaggtcctcgatatccttgttaaccttctgtctcattgatctctctaatattgacagtggggtgttaaagtctcccgttattattgtgtgggagtctaagtctctttgtaggtctcttaaggacttgctttatgaatctgggttctcctggattgggtgcatatgtatttaggatagtttgctcttcttgttgaattgatccctttaccattatgtaatagccttctttgtgtcttttgatctttgctggtttaaagtctgttatatcagagactagggttgcacccctgcttttttttttttgctttccatttgcttgatagatcttcctccatccctttattttgagcccgtgtgcatctttgcacatgagatgagtctcctgaatacagaacactgatgggtcttgactctttatcgaatttgccattctgtgtcttttaattggggcatttagcccatttacatttaaggttaatattgttatgtgtgaatttgatcctgtcattatgatgttcgctggtttttttgcctgttaattgatgcagtttctttatagcatcgatggtctttacaatttggcctgtttttgcagtggctggtagtggttgtttctttccatgtttagtgcttccttcaggagctcttgtaaggcaggcctggtggtgacaaaatctctcagcatttgcttgtctgtataggattttatttctccttcacttatgaagcttattttggctggatatgaaattctgggttgaaaattcttttctttaagaatgttgaatatcggcccccactgtcttttggcttgtagggtttctgctgagagatctgctgttagtctgatgggcttccctttgtgggtaactcgacctttctctctggctgcccttaacactttttccttcatttcaaccttgatgcatctgacaattatgtgtcttggggttgcacttcttgaggagtatctttgtggcgttctctgtatttcctgaatttgaatgttggcctgccttgctatgttggggaagttctcctggataatatcctgaagagtgtttgccaacttagttccattctccccatcactttcaggtacaccaatcaaatgtagatttggtcttttcacatagtcccatatttcttggaggctttgttcatttctttttactcttttttctctaactttgttttcttgctttatttcattaatttgaccttcaatcactgataccctttattccacttgattgaattagctgatgcagcttgtgcaggcgtcacgaagttctcgtgccatggttttcagctccatcaggtcatttaaggtcttctctacactgtttattctagttagccattcatctaatcttttttcaaggtttttagcttccttgtgatgggttcgaacaacctcctttagcttggagaagtttgttattaccgaccttctgaagcctacttttgtcaacttgtcaaaatcattccctgtccagctttgttcatttgctggtgaggagctgcaaacctttggaggagatgaggtgctctgatttttagaattttcagcttttccactctggtttctcctcatttttgtggttttatctacctttggtctttgatgttggtgacctacagatggggttttggtgtagatgacctttttgttgacgttgatgctattcctttctgttagttttccttctaacagtcagttccctcagctgcaggtctgttggagtttgctggagttccactctagaccctgtttgcctgggtatcaccagcggaggctgtagaacagcaaatattgcacaacagccaatattgctgcctgatccttcctctggaagcttcgtcccagagggtcagctgtctatatgaggtggctgtcggcccctactgggaggtgtctcccagttaggctacgcagggatcagggacccacttgaggaggcagtctgtctgttctcagagctcaaatgctgtgctgggagaaccactgctctcttcagagctgtcagacagggacatttaagtctgcagacgttttctgctgccttttattcagctatgccctgctcacagaggtggagtctagaggcagtaggccttgttgagctgtggtgggcttcacctagttcaagcttccccaagccgctttgtttacctactcaagcctcagcaatggcagatgcccctcccccagccaggctgcagtctctcagatcaatctcagactgctgtgctagcagtgagcaaggctctgtgggcgtgggagctgccaagccaggcatgggagagaatcaccttgtctcccggttgctaagaccttgggaaaagcacagtatttgggcgggagtgtcctgtttttctaggtagtctgtcatggcttcccttggctaggaaagggaaatcccctgatcccttgcgcttcccaggtgaggtgacgtctcgccctcctttggctcactctccatgggctgcacccattgttccaccagtcccaatgggatgaaccacgtacctcagttggaaatgcagaaatcacccgtcttctgcgttgatcacgttgggagctgcagaccagagctgttcctattcggccatcttggaatgcccctcccttcctcttcttcctgtactttaaatatgtcatctcattctctcctggcatgcaaagtttctgctgagaaatatactcatggtcttaaaatcgttcccttgtatgtgactagtcatttgctgctttcaaaattctctccttgtctttgacatttgagaatttgattaaaatgtgtcttggtaaagatctctttattattaatctatttcaggttctttgggcttcatggatttggatgttcatttttttcttccagatttggggtggttttcatcattatttctttaaataaactttatgccccttctctttctcttttatttctgtaatacatatattggttcttttgatactccataagtgccatagactatcttcactctttttaactccctttgctttttgttcctctgactgggtaattttaaatgaaccatcttacagcttgctggttcttctttctgcttgatcaagtgtgctgtcgaaagctctctatggaatttttcagttcattcattgtattcttcagttccagaatttctgtttgtttcttttttgtggtttctatttcttttttgattttttttattttgttcatgcattgttttcctgacttcatttaattttctatctggattctcttgtagctcactgagcttcattaagatgtttgttttgaattccttgtcaggtaatttgtagatctgtatttctttagggtcatttagtggtgcttcattttgtgcctttgtggtgtcatatttccctgatgattcatgatctttgttgccttgcattagtatctgcccatttgaagaagtaggcacctcttccagtctttactgactagctttggcagggaatgccctgcaacagtcaactatttacagattctggttaggccattttgcagggcctatagggagggcttgcctagtgcctgggtctgtgggggctggcctggtactggggggagttctacagttaagggctgtctggccgagtgcctgggtccacaggggcaggccaggagcctggggccatgagagctgacgtggcagtggaatggccctggaatctgggtccacaggggttgacctggatgttagctctgtaggagtggacctggagcctggggctatagacattgacctggtgctaaggtctgtggtgaagtcatgtgctcacgttactcttcttgccccatacaaagggtatttctctttacactgtgctgtgcagggtaggaatgaatgatacaggtaatgtgaaactgtccttaccgtcttcagtgtgccttcttatttccatgcttcactgaggtgctatactttctcacctggattcctcaggtcttgtgaaagtttttttttgtgcatggattgttgttcaaattgatgtttctatgaggggacaagggctggaaactcctattctgccatcttactgatggcactctagtgtgacttttgaatccgccagtaggaaaccttttatcatcctaagaagcacagatgtgtttagctattttatttgaatttggaaggatagtcagaaggacctggtccacaaaagccagaagaagggacttgattctcaatatactactatttaataaagtcagaattggaaagcctacagattcctgtttcatattatcactacatccatattacttatactatgcatctctcttctttccttttctagaagcattctttttaaaggcttgcttgctttttgttttgttcctaattttcctagttttcttcaaaaatttcctgccatttagtaatgcatattgcttttctagaattatgcatctcagcaaagattacatgaggattcagaaatactttttagcatgacttctatttcttttataccccaaatcttataaacctagttaggtccgcctttgtagttcactgtctaaatctattttcttatattttgattgttcaggtaaaggttttattctaaaataatgaacactatacattgacagaaacaaatggatgaatttcaccagagttactacattcaattatgttagctatctaattcactatatatataaagcttgtagctttgaactaattagggttgtagatttttacctttgtttttttttcttttttgaaaaagagaagcaagcttctgtcttgatttttaattctttaatttagtgcaactgtaactggtggcatgaatttgttattactattggcaaatttctaaatcttgtaacccaaattgctcattctatttttttcagatcaaagccagtgtttaccatgcaatcccataaacaactgcataataaacttaattctatttttgtatttgtttttagttgatgctgtaacaaatcaccacacattcagtgacttgaacaacacaaatttcttaaattatggttctgcatgtcagaagtccaacatggatctcatggggccaaagtcaagatgtcacaggactatattcctttctggagatattaggggaaaactcatttccctgctcaaggtttagacaagctctttctcatttctctttcattctctcttttttttttcatctctttcaatatgattgtaatcccatgaaacatagttcagcattcaggaagaaacaaacttaaactatgtaataatcattaatttatgtaataaacttaatataaaattaaatttaaatatttaagattataactataagataaaaactgtgagttttatctaactcacagtattccaattttctaattatttccttaattgtgatactcagaagacaggagagagagactttactgttgatggtgatggtgatggctgttatgatgttgaacttttgagggtcttagtttcccttttatacacatgtaagtcatccggtagtcttttgatagttgtcttagttattaagatatttgagagtttcctatttaattcagtttgttcagcctattttttttttcattgagatagggtctcactctataactcaggctgccacagcctcaatctgccaggctcaagtgatccttgatccacctcagtctcctaagtagctgggactacaggtatgcatcaccacacctggctaatttttttatttttcatagaggcgaggtctcactatgttgcccaggctggtgttgaactcctaagctcaagcaatcctcttgcctcagccttccaaagtgctgggcttgaaagtgtgagccactgcaccagacctcaacctacttttttttttttttttttttttaaccactggagatcttattttctgactaaatctaataattttttatggaaaatgtaagtatatttgtgaattgacagtagggttaaaggcatgatgccctttggaattgctttgttaacatcagaagcaatatctaagatccccctttttttttttgagacaggatctctctctgttgcccaggttggaatgcagtggcatgatcttggctcactgcagcctcaacctcctgggctcaagccatcctcccacctcagcctcctgagtagctgggaccacaggcatgcactaccatgcccaactagtttttttgtgtattttgtagagatagggttttaccatattgccactttctgttttcgaacttctgagctcaagagatccacccactttggcttcccaaaatactgggattacagatgtgagccaatgtacccatgcagatccttttcttaccttttaaaagattactggaaaatttgaacatgcctcaacattttaacatatgtgaatgccattttgatatgaatgcaaagtggtgctgatatttacatatgggatctatccgtagtaactgacttttgatgctctttctttttagaggttgctgtggactgaatgtttgtgtctccccacaatccctatgttgaaacctaatccccaatatgatgatatctggggattgaggctttgggaggtaatcaggtaatgagggtaaagccctcatgatgggcttagtgccattataaagagagacccaagagagtttgatttctctctctgtcctctggcttgtgagggcacagcaggaagacagcaaaccagcaagagtcatcaccaaatgtgaccatgctggtactgattttaaagtttcccccgtaattgtgaaaaataagtttctgtttaagcaacccaacctgtggtattccgttatagtagcccagactaagacagagatgtttaaattttattgtgctattaaataaaagtaccggtgcctcaaagctctgttgtttagatctaaaagatctaaaggtatgaaatgaatattgttgaggcaggatgaggtggtttggatttgtttatttttctccaacttttattgtgaaaaatttcacacgtcggaagagttgcaagaatagaacaatacagtacaatagtaccagtgtgtcttaattattattttgctgcaaaagcacacttgtactttttctctctaatgtgattgtgtgtgtgtgtgtgtgtgtgtttatctgttttcttccctgacccatttgagagtgagttgcagatattttacctccaaatattttagcatgtatcccatttaggaagtttaacattgatacaatattatgtatcatatcgttcatatgcaagtttctccagttttcagatttagaaatagcaaatgattctaaaagggcataattactttgaaaaattgaaaatcactttgaaaaatctggagttttaaagatgatttaccatatgggaaactgtggcaaattttaaatgaatatcctgaagtatgattctaatccagattgaattcaagctgtgaatttttgttttattttctaaatttttttatttcagtagatttttgggggaataggtggtgtttgattacatgaataagttctttagtggtgatttctgagattttagtgcacccatcacccaagcagtgtacactgtacccagtgtgtagtcatttatcccttgccacccctcaccctttacctccagtccccaaagttcaatatatcattcttatgcctttgtatcctcatagcttagctcccacatatgagtgagaacatacgatgtttcgttttccattcctgggttacttcacttagaataatagtctccagttccatccaggttgttgcaaataccattatttcattattttttatggctgagcagtgttctattatatatatatatacctacctttctcccttcccttccctcccctcccctcccctcccctcccttcccatcccctcccctcccctcccctcccctcccctcccctcccttcccttcccttcccttcccttcccttccacagagccttgctctctcaccaggctggagtgcagcagcatgatcttgtctccctgcaacctctgtgtcccgggttcaagcaattctttggcctcagcctcccaggtagctgggactacaggtgtgcgccaccacgcccagctaattttttttggttttgtatttttagtagagatggggtttcaccatgttggccagggtggtcttgatctcttgaccttgtgatctgccggctttggcctcccaaagtgctgggattacaggtgtgaaccaccacgcctaacccatatataccatattttctttatccactcattgtgatgggcatttgggctggttccatatttctgcaactgcaaattgtgcgctataaacatgcatgtgcaagtatctttttcttataatgacttcttttcctctggatagatacctagtagtgggattgctggatcaaatggtagatctacttttagttctttaaggaatcttcacactcgtttccatagtgattgtttgcattcccaccaacaatgtaaaagtgctcctttttcactgtatccatgccaacatctattattttttgatttttttgattatggccattctttcaggaatgaagtgatgtcacgttgtggttttgatttgcatttccctgatgcttagtgatgttgaacatttttccatatgcttgttggccgtttgtatatcttcttctgagagttatctattcatgtccttagcccacttttttttgatggaattgtttgcttggttttttttcttgctaatttgtttatttgtagattctggatattagtcctttaccagatgtatagactgtgaagactttctctcactctgtgggttgtcaattaactctgctgattatttcttttgcttcgcagaagctttatagtttgattaagtttcatctacttatatttgtttttgtcgcatttgctttcgggttcttagtcatgaagtctttgcttaagccaatgtctagaagggtttttccaatgttatcttctagaatctttatgatttcaggttttagatttaagtgtttgatccatcttgagttgatttctgtataaggtgagagatgagtattcagtttcatttttctacatctgacttgccaattaccctggcactatttgttgaatagggtgtcttttccctactgtgtgtttttgtttgctttgtcaaagatcagttggctttaaatatttggctttatttctgggttctctattctgttccattggtctttgtgcctatttttataccagtaccatgctgttttaatgactatggccttatagtgtagtttgaagtcaggtaatgtgatgcctccagatttgttctttttgcttagtcttgctttggctatgcgggctcttttttggttccatatgaattttaggattgttttttatggttctgtgaagaatgatggtggtattttgatactgcattgatattgagaattgcaattccagtttgatattgggaattgcattgaatttgtagattgcttttcttttggccgtatggtcattttcacaatattgattctactcatccatgagcatgggatgtgtttccatttgtttttgtcatctgtgatttccttcagcagtgttttgtagttttccttgtagaggtcttttacctccttggttaggtatattcctaagtttgtttgtttgtttgttttgcagctattgtgaaaggggttgagttcttgatttgattctcagtcaagctgtgaattttcaatatatttttgggcataaaaactatctttaaatggtgtgaggacttactatgtatattttgatgttttcttatagtttatatactttcttgtgaagacaaaaatagggggtcttcaaagtcttttttttttttttttttgagacagggccttgcgatttcacccaatctagagtgcaatggcatgatcatagctcactataaacctgacctcctgggcttgagtgatcctcccatcccagcctcctgagtggctaggactacagtcatgtgccaccacgtggctttattttttattttttcgtggagacaggatcttgctatgttgtgccaccacatggctaatttttaatttttttgtgtgtggcaacagggtcttgctatgttgcccaggctggttgcaaactcttggcctcaagcaatactcctgccttgactttccaaagtgctaggattacaggcatcagccactgcccccagcctacaaagtcttgaggtacgaattaggggaaggtttcttgtcaagttttcttttaactctaaaattctatggctttcaataatttaacagatatttaaactattaaatatgtaacattgtattgggtgctctaggaaatgtggataatccttgatcaccaagaattcaagggaattaagaacttatttacaaataaatgcatgaaagtaaactgtatatgaagacttgtaagaaatattttaacaaagtgcagtgaaaattcagagacagaagaaacttggctgggtggtaagaatagaacagataagcttcattggattgtaaatacttgttaacagaaatccagggtctctactataattttcctgtgtatacaataattttaactggaattaattgtattaacccatttatgccagaagttgcaaatttttttttgtgaaaaatcagatcttggtgataaccttgagcagtaggataaaaataactcccacaagcttagtgttccagtaatggaacactaggcataaatgtattaataagcatgaggtatgcataattcaattagattaaccaaaaatagggaaatacttatgtttgtgatatattgcaagtaaaaattattgaaatttttattgaaaataatacattataacaaatttaagtgtagtaaagtagaaattaaaaagaaaaatgtcatctatagccacctcattcatagataatacctattgacatctgttttttttttcattttttctatattgtgtgcatgcttatatttgatgttgcattctgcttcaaattagttgataaaataattttttttcactttagtaccacacttttgcaagcaattttattggcagcataatattatattgagtagttgtggcatgatttactaaaacatttttctattgtttaacaaaataattaattctttgtaggaacaagcaactgtagaaatggtaaagttatgatagagaacaaacttgttccaagatctcttggaaggatcttccttaattttttatcctgacaatttaatacaccaaatattttacatgatttttttcttgcttttttttactactattttaacttaccgttattaaattatttacgcttttcattacatctagtttagaaaatttagtgtttcattgactatttggaaagattattctgtatatgctcagagaagtggtagaagcatcaagccagctgatgtggatcccaaagggtttggtgcaggaacatctgtagtggtgcatggccagggacagccatccccataggctcaacttgctcctataggagtctttagtgctaggggaactgtcagtcctcaactctgcaggatggtcttgcccatcagatgaggcaggtccaacctgagcgccccttggtctgctgacccctcccaggccccattcctgcttgcagggcagcctcaggtgccctggggggcctgcattatagcttctgtactggtagaccatgggtgatcagtggagagtttcagcagggtggtttctgtgggcatgaaccagcctgcatactccctccctatgttgcagtttcccctaacccatggcaacttactcagctggcatgtatctgtgtgggtgagttttgctttcctttgccacaccagtgtgagggagtgcagtccgaccccctccacccaccaactgccattgcaggcagagccttggcagacacagccagccttctccaaccagcagcctgcccttgcactaacactgctgtgggagtcaaactaggcacagagaacagcagatcctccccagccctgagtgacaactcctgcttgcagggcacagagaaggcacccagacctgcacctgccagtaccccacccctgagccaacaccatttctagcatgactgtgcgcacagtcaccagcaggggccccctgcgccctgctccagctgcattcccttcactactctggtgaacacccacatggagacaggcatcctggcacctactagcactctgccacagctgctgctaccactgctgctggcacatgcaaatgaggatggatcctgctgtcattgcactatgaaatgctttcattcacaccacctatcagagtgtagtgaccagcggtctgggaacaccttaggccccccccgaccccagcacagtggatttctaacctcgaggagccagagaacaaagagccaatgcaagtccgccagagttagagcacacagtcctggagttgagagctgagcagtggccctctaacaccttccagaaatgaagccagtctgctgaattcacctataccacagtcaaactcttatggtcatcaaatagaataaaaggaaaaaacaaacacccaaaggtcagcaacctcaaagattgaaggaggataagcccacaaagatgagaaagaatcagcacaagaaccctgacaactcaaaaagccagagtaccttctttcctccaaatggtcacatctccgttccagcaaggattctgaaccaggctaagatggttgaaatcacagaaataagattcagaatgtggataggaacaaagctcattgagatacacgagtatgttgaaacccaatccaaggaagctaaaaatcaggataaaacaatgcagaagctgatagacaaaatagctagtatagaaaagaaggttacaacccaacagagctgaaaaacacactacaagaatttcataatgcaattgcaaccattaatagcagaatagaccaagcagaggaaggaatctcagagctagaagactggctttctgaaataagacagataagaatagaggcaaaagaatgaaaaggaaggaacaaaacctccaagaaatatggaattatgtaaagagaccaaatttatgactcattggtgttcctgaaagagatggggagaatggaaccaacttggaaaacatatttcaggatatcatccatgagaacttccccaacctacctagagaggacaacattcaaattcaaggattgcagagaacccaagtaaaatacttcacaaagaagatcatccccaagatacatactcatcagattctccaaggtcaaaatgaatgaaaaaaatgttaaaagaagctagagagaaaggtcaggtcacctacaaagggaagcccatcagactaacagacccctcagcagaaaccttataagccagaagagattggatgccaatgttcaacattcttaaaagaaatcccaacccagaatttcatatacagccaaactaagcttcataagtgaaagagaaataagatccttttcagacaagcaaatgctgagagaattcattactaccagacctgccttacaagagcccctgaaagaatcactaaatatggaaaggaaagactgttaccagccactacaaaacacactgaagtacacagaccagtgacattgtaaggcaactacataacaagtctgaaaaataaccagggtctgtgacagtgtcagatccaaacatactaatactaaccttgaatgtaatgagctaaatgccccaattaaaaggcagagagtggctagctggataaagaatcagacccattggtatgctgtcttcaagagaccagtctcacacggagtgacatacataggctcaaaataaagggatggagaaaaatctatcaagcaaatggaaaacagaaaaaagcaggggttgcaatcctagtttcacacacaacagactttaaaccaacaaagatcagaaagatcagaaaagacaaagaagggcattacataatgataaagggttcaattcaacaagaagtgctatatcctaaatatacgtatatacacccaacacaggatcactcagattcataaagcaagttcttagagaccttcaaagacagattcccacacaataatagtgggaaagtttaataccccactgacaatgttagataattgagccagaaaattaacaaagatattcaggacctgaactcagcacaggatcaaatggacctgatcaacatccacagaactctccaccccaaaaaaacagaatatacattcttatcattgtcacatggaacatactctaaaattgatcacataagtggaagtaaaacactcctcagtaaatgcaaaagaactgaaatcataacgaacaatatcttggaccacagcacaaattagaaatcaagactaagaaattcactcagaaccatacaattacatggcaattggataacctgctcctgaataaactcttggataaataatgaaattaaggcagaaataaaagaagttctttgaaactaatgagaacaaagagacaacataccagaatctgtgggatacagccaaggcagtgttaagagggagatttatagcactaaatgcccacatgaaaaagttggaaaggtctcagcttgacaacctaaatcacaactaagagaactagtgaaataagagcaaagaaatcccaaagctagcaggaaacaagaaataaccaaaattagagcgaactgaaggatatggagacatgaaaaaccattcaaaagatcagtgaatccaggagctggttttttgaagaaattaataaaatagaccattagctaggctaataaagaaggaaagaggaaattgaaataaatgatcagaaatgacaagggtgatattaccagtgaccccatgaaaatataaataaccatcagagaatattatgaacacctctgtgaacataaactagaaaatctggaagaaaatggataatttcctggacccatataccctctcaaaactgaaccagcaagaaattgaatccctgaacagacaaataacaagctctgaaattgattcagtaataaatagcctaccaaccaaaaagagcccaggactagacagattcacagctgaattctaccagatgtacaaagaagagttgataccattcctactgaaactattccaatgaagttaaggaggaggaactcctctctaactcattctatgaggccagcatcatcctgaccaaaacctagcagagacacaacaaaaaaagaaaactttaggccaatatccttgatgaacactgaagcagaaatcctcaaggaaatactggcaaatcaaatccagcataacatcaaaaagcttatccaccatgatcaagtaggttttatccctgagatgcaaggttggtgtaacatatgcaaatcaataaatgtgatttatcacataaacacaactaaagacaaaatccacatgattatctgaacaggtgcacaaaaggctctcaataaaattcaatactacttcatgttaaaaactctcaataaactaggtatcaaaggaacatacctcaaaatagtgagagccatctatgacaaacccatagtgaacatcatactgaatgggcaaaagctggaagcattccccttgaaaacttgcacaagaaaaagatgccctctcttggcatcctttttccattctcttggaaaagaataccactcgttttcaacatagttttgaaagtcctggtcagggcaatgaggcaagagaaagacagagcatccatataggaggagaggaagttaaattatctctttttgcagatgacataatcgtatacctagaaaacaccccagtcccagcccaaaagctcctccagctgatacacaaattcagcaaggtctcaggatacaaaatcaatgtgtaaatatcaatctttcttatataccaacaacagtccagctgagaaccaaatcaggaatgtaatcccattcacaattgccacaaaaagaataaatacctagaaatacagctaaccagggagatgaaagatctctatgaggagaactacaaaatattggttaaagaaatcagagatgacacaaacaaatggaaaaacattttatgctcatggataggaagaatattgctaaaatggccatactgcccaaagcattgtatagattcaatgctattcctgttatactaccatttacatttttcacagaactagaaaaaactattttaaaattcatatggaaccaaaaaagagcccaaatagccaaggtgatcctaatcaaaaagaacaaagctggaggcattatgctacctgacttaaaaccgtactacagggctacagtaaccaaaacagcatgatactgctacaaaagcagacagatagaccaatggaatggattagagaacccagaaataaggccatacacctacaactatctgatcttcaacaaacctgacacaaacaagcaatggggaaaagattccctagttaataaatggtgctagataactgactagagatatgcggaaaattgaaactggatgccttccttacaccacataaaaaattaagctggattaaagactttaaaatcccaaactataaaaacgttggaagacaacgtaggcaataccattctgggcataggagtgggcaaattttcatgacaaagatgccaaaagcagctgcaataaaggtaaaaattgacaaatgggatctaattaaacgaaagagcttctgcatagtggaggaaactatcaacagagtgaacagacaacctacagagtggcagaaaatatttgcaaatgatacatctgtcaaaggtcaaatatctagcatctgtaatgaacttcgatttacaagaaaaagcaaccccattaaaaagtgggcaaagagcatgaacagacagttttcaaaagcagacatacatgcaatcaacaatcatgaaaaaagactcaacatcactaattactagagaagtgcaaatcaaaaccacagtgagatactgtcccacaccagtcagaatgctattattaaaaagtcaaaaaacaacagatgctggtgaggttggagagaaaaaggaacacttatacgctgttgatgggaatgagtgtaaattagttcaaccattgtgggagacgatgtggcaattcctcagagacctaaaaacagaaatgccatttgactcatcaatttcatgactgggtatatatccaaagatttataaatcgttctattataaagacacatgcacttatatgttcattgcagcactattcacaatagttcgcaaagacatggaatcaacccagattcccaatgatagaatggataaaggaaatatacaccatggcattctaagcggccatcaagaagaacgatcatgtcctttgcaggaacatggatggagctggaggccattatccttagcaaacaaacacaggaacagaaaaccaaataccacatgttctcacgtacaagtgggagctaaatgatgagaacacgtggacacgggaacaacacacgctggggactatcggaggatgaagggtgggaagagggagagaatcaggagaaataactgtgtactaggcttaatacttgggttactaaataatctgtacaacaaacccctatgctacaagtgtactatataacaaacctgcatgtgtacccttgaacttaaattttttaaaagtttattaaggtgaaaatggttattgaaaaatcttaatctctgaattagtaacagttcccacatgctaaatgatgtatcccaatatctctttatttaaaatataaaactaggcagaaactgaaattattttctagtaggagagtcttttaaaaggtagcattcataagtgttgtttacatattatgcatgggtcactgacaatcaatgtgtctgtaaacaactctgttgtagttagggctcttttcccttttgaattttgattgctcagccaagggttctttgttgatagctggtttgagtacttttatatactatacttaattcagattaatgagctttgttaatactgatttgaactagctagattttatttgtttacttgtttttgttatttttaagaacgaccaattccagatctatgctaatttaaatatgtcctcaaaaagggggcacatatttaaaaaaacaaaccaaaacatacatttatgttggaaaaatcttcttagttcattgttagtaccctaatttttgtaggttttcataggaattaactctttcaaagcaccttttagactatgttgtcggcagctagatgctccatttacttcaagaaatgcaacaaaattgaaaccagtttaactgctaagtgattcgaagtaatgcaaagtacatggactgctaaatcatagaggatctaatttttttttaaaacccatttgttaggctctcatataaatataacacttaaaacaataagcacatatactgttatataattcaggaagatttttagcttgtagacttccaaagaatgtggcattttgttttagtttttgaagtacctcttttttttttttttaatttcagtaggttttcggggaatgggtgttgtttggttacatgaataactttagtggtgatttctgagaatttggtgcacccatcacctgagcagtgtacactgtactcagtgtgtagtcttttatccctaactcctcttccaccctttcccccgagtccccaaagtccattgtacgaagatactgtacctttcttttaatgccagtttataatgcatgttcgaacttttaacttcactaagtctatgaaggtaagatatacatagtaagaactaaacctgctaaagatcatcctgtttatgcaacatcattaatttaacaaataagcagagtaatgcatttaggacaaaagtttatgtttgttattagggatataaagtctgttatccccaggatcttagagactaagagagtagtataaacaaatatttatagtaaactctgtaattactatagaaaatatcacagaagcacaacagctcagctaactctgccatattaaagtagagcagtattatgactgaataaatcaaaacagctgacatcattagacctgctatgattgataacaggtttttctctttgacaagtggttgtgatatatgtaagaattcctagtttttctttaatatgatagataaacctgactaatgattttgaagcatttagtggttgaaatctttctgtgagctttttgtttatcttttatttttagcctgatagtctgataaaggaactgtgctttaatttgcttcttttttgcttgttgctaatgctttttatgatttccaaatatttcaacttcattgttgaaaaatgaacatattttcaggtagatattatattttaatggattacaacttagattttaaatttgctgaaatttttctttgccaggggtaaggtttctggtcaatataaatagaatcatcatgtgtttctgtctccaaaaagttagctgcatattttctgaatttgaggtttgaattaagaattgggaatgccaattgatagatggatggttaaatgcttatgatagctcactgtctatgaaatcctatatgtgtttgttaaatgtgaccgtcagcactaagtaaatcggtaaatagattactttcccaccctaaggatctgcagagtgtcttagaatttcacaaaaggagcaaacctctgacttgatggaataaattttgataatcagtttcttgtttgtttatctgtttattgatctatttcttagtataattatgattgcattttatattggacttttgttttttacctttttaaaaaaaccacattgagccaattttcaattgtttaaactttcagcatgtttaaatatttgtgtttatagttttcagaatttttgctcagttttggaatagtaccgattaccaaaggtaaacctgacccttaatgagcaagtaaatttgtaggctgtatacatttttttaaagtaattgttatctaggccacattagccttcaagctacattgtctattgactgaggctccttagatctcttataaaatgcattatattgcctgacttgcatattatattatctaggtaaagcaatgtaattaaagcttaactgaggtcatgggtggtggctcacacctgtagtcccagcactttgggaggcaaaggcaggcagatcacttgaggtcaggtgttcaagaccaacctgggcaacgtggggagagcccgtttctacaaaaatacaaaaattagctgggcgtgatggcgcatgcctgtaagtcccagctacttggaggctgaggtgcgtggatcacttgatcccaggaggtggaggttgcagtgagctaagatcacaccactggaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggagcagggcacagacaaacaaaaaggcagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcctatcagactaacagcagatctctcggcagaaaccctacaagccagaagagagtgggggccaatattcaacattcttaaagaaaagaattttcaacccagaatttcatttccagccaaactaagcttcataagtgaaggagaaagaaaatactttacagacaagcaaatgctgagagattttgtcaccaccaggcctaccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaatattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaatcgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaacaggaagaagttgaatctctgaatggaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactaccttacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcactcgtatgtttattgcggcactattcacaatagcaaaaacttggaaccaacccaaatgtccaacaatgatagactggattaagaaaatgtggcacatatacaccatggaatattatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggaggggtagcattgggagatatacctaatgctagatgacacattagtgggtgcagcgcaccagcatggcacatgtatacatatgtaactaacctgcacaatgtgcacatgtaccctaaaacttagagtataattaaaaaaaaaaaaaaaaaaaaaaaaaaaaaaaaaaaaaagatcacaccactgcactccagcctgggtgtcaaagcgagaccctgtctcaggaaaaaaaaaaaaaaaaaaaaaaaaggcttaattgattgaaccagattcgagaaaacagtgctaaattataattttctcaatactgtaaatatttttcaatcttcagcttcattaacttctataatttgaaattatcccaattattacctgacatgtactaaaattccctaaaatggatcttgagtaacattttcacagtacgataatttttctctctgtatatatttatatagtcacatatatgcacatacattatacaagcattacttttctataactgtaaggtcagaatttgaagttgtgttttctttatctttttatttccaatacttggcatcaagttgatattcattagaagtaaaggaggaaggaaatgaataatcttcagatactaagaacattacacttaaattattattaaatctaatttgcattctcatatattggcttagcttggttatttgtaacaagaatataaaaatatatgtgactgggaatgacatgaatagaaacttctggaaaatggaatggtaaggtctagagaagtggtaaatatttcatcactggaaatgagcaagcagaggttaggttattctttgacattgatattgaagcagagagtctctataatggatagaaagttcaaagtgacctttaggatcttttatcttcaaatttctatgaaaagtatatttactttaataataaggttaagatgttggagtgcatagagtaaaaaactagaaaagaaccagatgttagaaaggagatttcttaacaaaatacggttaaagaggatttctcatattttatatggaaagaaggaactttgatatttaagtaggaaccatcttctaggggaccctgttgattaaacaggaaatctagaaactagacaaagaaaaaaagaatttggctatatgaaagttaaaacttatattgcaaaagagaacataaaattaatagtccaaataaaattcagaaaataaaatatttgtaacagagatgccagataacaaatttgtatctataatatggaaacaactcttataatttgtttagaagataacccaatggataatgggcaaaggatatgaataggcaattttggaagatcaaatttagatggtcagtaatgtttcaaaagatgctcagacttattaactgttagtgatatgcaaattaaaataacaccaaactatcattttacatgcataaggttgtcaaagattaaaatagtcaaaacacttactactttggcatggggatgtgggaagtgatttgaatacattgctgttggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattgcggcacagatcattatattactatcacaaaaagcactatatgaattagagggactttctgtgaggtactgttgaatgaggaaagaaagatatacagaagtatgtattaatatatccaattcttttgtagaacagtgaccaaaatcctgtgtgtgagtttatgtatgagtgtgtgaacctacacatttatatgttcatatggcagggcagtatgtagcaaaagagaagaattcatactcagtggttagcatgtttttagagagttataataatacaacaggagtaggaaggaaaagggaggtaggcccataccaggtaattagatgtgagaatggaactcaaagagcaagtcaagactcaagatttaaatttgggagtgaactatagaggcaatattagatgctaacaaaaccgaatgtaatggctaaccctttaacatctatctgtattttttgtcctatattttaatcagtttctgcttcaccttggtcagcaaaagctcagcaataggttttgtaatattttctgttttaactagctcaaataaacacatattaattgaaaacttctaacagcttttatttattcaacaaatatttcttgatcacctgctttctggcaggcattgttatggcccctgcaatgacaaataagacatacagggtccctacataataaataaataaataaataaataaataaataaataaataaatatataatgtcagatcacataaaagctatgaagaaaaagcattttttcaacggataataagggacagagcagggaagggaaaaggagaggaggtttaactattttggataaggtagtgaggaaaagttttctttcagaaggtgaatttgacaaaagagctgaatgaaatgaagaaccagcccaactgtatatctgggagaagaacctgtcagtcagatagaacaagtaagaagaccttgaggccttgacttattctagaaacttgaagaccagagtgactaaagcatagggacatagagtgtgaaaagatgagttccaaaaggtaggtagggcctgatcttgtagggcgttgtcacccttgtaaggagacaggattttattctggttgtgatgggaagctgtggagggttatgagcactggaagattatgacattggaggctgtgctaatttggatttaagaaagctcactctgattactctgtagaaaattgattatagggtataagaggagaagcaagaaagactattgctctggagtaggcaagagatgatggtgaccctattaattagtagaagtagtgagaaaggtgtcagatttcagatacattttgaaggttaagggaggggtgcttgaagatcatgagagaatagactgatatattttagttgagtccactttggaatcacacaaaactatttttaattttgaatatactttagtgcccccagcattaattatgcagaacgttttaggctgtttaaaagcaaagcagataaattaaaaggaggttagtggttaaaacttctctttcctataaatctcaaagcaatcacaagacccctccaaacctcatatccctttttttttttttgctaatggttgtagatcacaccagtgttctacatttcatattctctcagaacttgctttgaccctcaatgtcgttctgttgtaatgataatgaaagttaaggtaacaaaaaccacttattgtttatcatgtgcaaagtattggtttaagtgcttttgctatattaaatccttttatcctcaaacaaccctattgtaacaaaaaccaagttcagtagcttgccactcacagagtccaattaacaagagcaaggtctggtataaagacagctactttttattccaaaggtagcttataggaagaagtataggcttcctgccttaagggtaccacttcccttttggagcagaaagagggtgcttttaaaggggttgcctggcacaccggcatgaatggcatgcaggggagaaagcaagcaggtggggagtcgatgtactagctttggtgctttatctactgggtagtcgagctggtgactgctggcgccttcttgggcaggcctaggttgtaaaaagcatcccaaaactctccagatgggagagagattcatagtgagcatgctttgggttgtagatggactgttgtctcttgaggcaacctcctgatgggtgagagttctgctctggagcttctaagtacatagttagatgaacttgccctgtaggaaatgtctggtaaagaggaagtaaaatagagctaagtaaaaagttggggaaaggagggaagagaaaagaagagagagagagaaaaaataattaaactatctcttggaaaattgggatacactatgaggtagctgctgtagctgttttacatgtgaggaaactactagtatatatgtactgtaagtggcattagataaactcagcacctaagcctactcagcatggcatattatattttatagtatcctctctactacttgtaaggggatagcgtttatgttatttcactaatcttttatatttttctgttttacatggtattgaaaaacggtaagcagaaggtttgagggaatagataatgctttaaaattttggcgtctgtaaatctaaccttttctcttatacttccaagtttgaatatcctgttgatttttttcttagaccacccaaatatcttgaaaattaccttgcttttgaacctaaacagtgtctctcagataacatttcacctctagaagttacacaaaaatctttcaacagataatgtcttgatttttgattgacagaatatggtcattgtattaccttatctttgtatcctcagtgcccacatagcacttggcacacagaaaatgcttagtgaatgtttactgaatgactgaatggagagaacagtttctctgtataatgtgatctcatttttacctactaaagaaagacaggtttgctttctaagatgggaaaatatgatcactgactgccccagattagacaccccagtggaaagagagaggttctatcttccagtattcatgtcaaccttattgaagaactctggcccttttgggggtcatgtgcctgctctttggaccaatcattactgccaaaaaaaatgagctattacaactggctaagcctaggtcaagttttccttttaatggccatggaggtatattgcattactgaaaggaaagctatgtggagcttgagcaaacaaagaatggcagctgtaattatccacaacaaaaattatatagaattaaaatttccaaacaagtctcaactcttgtttgcaattttatgaaaattataaatttatgaaaaagtgcaagttaaaaagaaaagaaacatggtatgtaaacatgggaaatgtacattttagtatttttgttaaggggaaagagaagcagaggtgaactctgtgaagtgattgaaaatagaaatcttaagggtaggcacctctcttttcaagtttccgtacagagattttaattcctttggtcaaaaggctgcaattcaagttgtttttgcaggcctggctcatttttccactgttttcctcatgggctcaaaggtctgttgaagtggtaaataaacgtgctttgaagctatcacaactcaccttgtgtagttgaacttgcttaggggcagttatcacagttcctagtaagccaagcttgtttctgacagctatggaggatgtgagaaagaacagaattggatagagaaccatttgggaaatgggagagatgtgagtgctgatatgctttcccctccatcgctaataaacttctagtgctattccttgttcttttaaatgtacctatagacattttgctctatgcaggaagtattccctaatgaaagaatggagtcagagcaaaaggaaacatctaagctttattgatctgtgcttatcttacattgctgctctctgctgagaaattgattgatttttttaaaaaaaaaacttcaggagcctttgttggatgttgccattgctgttgcaaaataggaaaacagttatgcataaattatctggagaaaatattttccttgatttttttttctttctaaaaatgtgtgggaagaaattatacaaagtgagtaaatggtggtattatttagaaaccattctattttcacttaggcaaccctaacattaagcaagaggatctttgtggagaatttactgttaatattgtttgcatatttacccaaacagcttgatataagggtttgtttttttgttgttgttgttcttaaattaccattttgagatctagaaatttttcccagcccaaataacaacaaaatcgtttactcattttaaaactttattgtttaaaaaaaccccactaacaaccctaaaatgaatgactccgtagttatttttaccttctttttatgaattccctcagctgaaattaggataatgttttgttttttccatcactattgaatactattcaattatcttttctttttttttttttgttttctttttcccaaatggctgttgaatttatttgcttgatcaataatggtcctggcaaaaattagttaaccaatgctgagacatttgtaatgaaatactaattttaaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagatttaaaaaaatagtatgctgatttctataacaaagctttttttcgtacaaaaatcaaataatggccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtctcatcggatggacctcaattatcttttcatagaaatgatgtcattgttatacacatgcagtttctgtggcattggaatgagcgtgacaccataaaaataattcttaaagattgtcaatgtagtgttttctatatcattgtttatgagagttatggtttctgttgtttttcgtgcataaaaaatgcaatttttaagtatttttaaaaatcaaacatttgtaaaccataatctcctgcatattgttggtactgtaagtgctacttaggtaacagaaatgttataagtatttgataagatgcttctaaacattatacataagaacagtaggcatttaagataaacagaagtgtaaaatacatttaatcctaggccttgacttttttttttttttttttacattctggataatattatctactcccatgacatttcaagtggatttacttgtgtaaatgtgcacatgattcaaagcaccaaatatctgtttggtcttttcaataattcttcctgggtagctatcccttctgctaataacttcatctttcatcaagactaaaaataaacttttgagatatcgcccttaagtttttctctacttagactgtttctctttcacgctgttgccagattatctttctaaaggcaaaatcttggtcatatgacattcctgctgaaatatctccaacatcttatgttgtatagaggagaaattctaaactctagcatgaacttagaggccatcagcaatctgtccttagcctaattttactagtttcatagtttgcccagtgatcctcctctaaccaccatattattaagccacatttaactgcatgctgtttccacacctgcctttatgaatccatcttcacacgcactgtttgccctgagtatccttattttgccgctcaaatgtcccttgatttctctaggattctgcatccttataacactgtgcctagatcaccataacattaatacattacattacagttaattgttgaagtctttctcactagactagggaccctttaaaagcatgaactagccaatatttttgtaaatcccttatcctgtgcccattgtggggacttgacatgtggtaggtgacatgcctttatatattgtattgggtgcagttgcagggtttaaatactttttccctctgaaagaacttgtttgaactgtaaaagtgtctaaggaatatagtacctttttcccctatcacattcttccaaagtaggacctgttaaggatattctggtaatttagttgtgggtagggggaggtaaccttaaagtatgaaatataaaatcttgttataattcacttgacagtaaatatttaaaactaagttaaatagcccaagagagttatctatactaacacaagttaggaaagaatgaaaagatggttgttagaaacaaatgcttcgtgctgcaaagaagaatcagcactctggcaaaaagctttctcagcaaggcaattcacttctgaagaagggtgccactcatacctggtgtggtcacaagagcacaccgagcagggtatggcaggggtttttatccctaacaaagttcctagcacttctgtgtcctttccccattggctgggtttggacctcacaatctaagctaacttgattggctaaggtttaaaattgaatacagttaatttccatgtattaactttctagacaaccttgaacaggtccttgtacaattaaaagattgggtcagatcatctggcagatttcttattgggtagttacaaatgactagataaatagtagttccataaaatttaatttctaagataggacatttaatgaatttactgaagctgatattgggctataacttaaatggttttgactcagtgaaagttgagttaatgaaggaaaaagtcacctttcaggagcatttgctcccaggggtggcacattaaacagcattattgtgattatgatctttacctcttcccccaaactcccttacataaccaaaggtttcctcttaagtcttctttatttctctttaaatgtagaggtcatttagttctttaagggggaaaagacagtaatttgaaaacgttcaaatgccaacatttttttcacatttaaaatcagtaaaataattattcttagggcaagacaaaatgggtaaaaatgactcatatatatttgcaggactacgggagtcataataaagcaaaacatttttttctgtatgtccagtgttagatttataaaatcaaagtcatacaaagactgatgtttaagcacattaatcttctattataatgtttagacctctcttagcttggctttaattgtaaaatcacaggccttgaagagagaataattaactctattactgcagcaaccacttaaagatctaaatattttggagtgttctatttgaaaattagagggagaactagtcactacaaaaccatctacagatctttgtgttctttttattctttctcctcaacatgtagtttgttgcatttgtaagggagagaaataaaaatatgtttttgggcataaattttaagatttttaaagcctgttcttttcattctgtcttcttcagagtggtctgctgactgatgaggcaaaacatttgtacccttggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaagggtattcaattaggaaaagaggaagtcaaattgtccctgtttgcagatgacatgatagtatatctagaaaacctcattgtctcagcccaaaatctccttaagctgataagcaacttcagcaaagtctcaggatacaaaatcaatgtacaaaaatcacaagcattcttatacaccaataacagagaaacagagagccaaatcatgagtgaactcccattcacaattgcttcaaagagaataaaatacctaggaatccaccttacaagggacatgaaggacctcttcaaggagaactacaaaccactgctcaatgaaataaaggaggatacaaagaaatggaagaacattccatgctcatgggtaggaagaatcaatatcgtgaaaatggccatactgcccaaggtaatttagagattcaatgccatccccatgaagctaccaatgactttcttcacagaattggaaaaaactactttaaagttcatatggaatcaaaaaaaagaccacgtcgccaagtcaatcctaagccaaaagaacaaagctggaggcatcacgttacctgacttcaaactatactacaaggctacagtgaccaaaacagcatggtactggtaccaaaacaaagatatagatcaatggaacagaacagagccctcagaaataatgccacctatctacaactatctgatctttgacaaacctgagaaaaacaagcaatggggaaaggattctctatttaataaatggtgttgggaaaactggctagccatatgtagaaagctgaaactggatcccttcctcacaccttatacaaaaattaattcaagatggattaaagacttaaacgttagacctaaaaccataaaaaccctagaagaaaacctaggcattaccattcaggacctaggcatgggcaaggacttcatgtctaaaacaccaaaagcaatgagcaacaaaagccaaaattgacaaatgggatctaattaaactaaagagcttctgcacagcaaaagaaactaccatcagagtgaacaggcagcctacaaaacaggagaaaatttttgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaccacttttacaccattggtgggactgtaaactagttgaacccttgtggaagtcagtgtggcggttcctcagggatctagaactagaaataccatttgacccagccatcccattactgggtatatacccaaaggactataaatcatgctgctataaagacacatgcacatgtatgtttattgcagcactattcaccatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaaagagatcacatggacacaggaaggggaacatcacactctgaggactgttgtggggtgtgggggagggggagggatagctttaggagatacacctaatgctaaatgatgagttaatgggtgcagcacaccagcatggcacatgtatacatatagtaactaacctgcacattgtgcacatgtaccctaaaacttaaagtataataataaaaaagaaaagcaacatttgtacccttgtagttttcttaaaccacaaatccaaattccaatcctagaatgtaactccaggatatgaaagatgggaaagaataatattacagtgtaaaatttgaagaaaactaagagaggaattttcatacttcactaaattctcacatctagtagttctgggtcagtgcccttattgcccttacctgacatttaaggcatatattgtgcatctttgtaagtaaatctgtgtggatacaatatagctttttgaatagatgttgattttggtttctgaataaaagtttctcttgtgatgaacctcacagtggcaaaatgtagatatgagaaggagaaaaccatttcttgagtaaaaatggtaaaaaaaaattttttttttgatctcacggcagcaaacttccaaaggcctttgatgtttgccattttgttgtgatagttaactaatctataatgtttgggactattgagttttgtgatttgacatttgttgtattggaatctgatctgtaaactagtagcatggcttgatgtagagctttgactaaagagactgagagaatgaagactaggaaatgaatttttactatctcttctcaaatgtttgtctaaaattagtcaagaacttcatttcattaaaaacgttaaagtttttttatttatatatgacctccaaaaatgattgaatattttttgaatacaaattctgtgccagtcagcacaccagctttttacatgattatctcatttaatccttaacacaacctcatggaatagatgttatcttcatttacagataaggaacattgggttcagagagagaagtattttgttcaagaccattttttcagctggtaaatacatgacagaggtaggactcaaaattcaggttttgtctgattccaaagcctgtgtgcttagtcactattataaaaacaaactcatagttcttgagtgagggaattatttaaggcttaagttacatttaccttttagtttaaaagacagtatatgtagtgactgtgtatcatgatgatccgtggtactgattattgaaatcattccacagaggtaggcatgtgcaggttgttgaattgtactattatagatcaattgtgcctggcactgttaacattttgaactgggtaattaatttgttctggaggactgtcctgtgtaccataggatgtttagcagcatctctggctacactcactagatgcgtataccactcccttgtgacaatgaaaaattgtcacgactttcagaaaaatcatcatccttctatctccaacagaagagtgaactcatgtttaacttcatgtaggtacagatgggatatttatcaatatgtatatagtacatagattaatagacacacatatttccttgttctgtcagctgacaaggtctagaagcagtgactgctcagtagcagtaagcagaccttacattcaaatcttggtttctaatattctccaacacaaggaaccaggactccttttagaaatggcagattctaggactgggttggaaaaaactacaagatgagcctggagcattttgtagtgccagaaactaaggaagttctcacaaaaaaaaaaaaaaaaaaaaaaaagacaaaaatcccccacaattataagagtatgccaaagggacacagaaactaacaggagagctctcaactgccaaatctggaataatttatgcaaaaaaaataaatagaatagtattgcattataacccaaagtataaaacaaatatccatgagcccatattgatataaataaatgatctcataaattaataaattgaagtgaagtagacaaatctcctgtgaggaattccaaataatttatgtaactacctgcccccaaggtgtgggacataactccccactccttaggtatgagctacccatagtgacttccttccaaagagcacaatcagtataggagagggaaaaataatgctccagtggagaaatctgatgaatactaccttagccaggtatttaaagttaacttcagcagtgataaatcatattgatagtgtgtgtatccttaacatgaagtaataagaatggcactttaccttactcgtcttcctctcaaaaacacataaccccagtctcatcgtgagaaaaacatgagacaaactacaattgaaggatattctacagaatacctgtttactactcctcaaaattttcaaggtcatcaaaaacaaggaaagtctaagaaactgtcacagataagggaagcctaaggaaatatgacaagtaaatgtaatgtggtattctggatgcgatcctggaaaaggggaaaaaaaactttaggtaaaaaattaggaaatttgaataaaatataaactttagtcaataatgtatcaatattggttcattaattgtgaaaaatataccatagtaatataatatattgataatagggggaattggtgtagtatatgggaactctatactatctttacgatttttctgtaaatctaaaacttttctaaaataaaagttttatttattttttttaaaaaggcctcaaaacattgccatatgtctctagggagcaaaatttcacctagttgagaaaatcaccattatagttaataccatagagaaaaaaagtatatttcatttttgtttctgttgagtccctagtggagaaataacattaatggaaatgcctaggatacctagtaggcacaaaggtgcaaagtacatatttacttaccttttctaatctctctccccttcccccttaaaattttagtgtccttgagggttttatatttttgtttttcttctcattctggtagctgtcttggattacctcatttgtgcctgtagcttcacatatcatccatatgttgatactaccaattcaaaatctttaggctgatcttagcttctaagtctagcttcagagtaagcatctatctatacttttatgtcccataacatgtcaaattcactagatttgagtcacaaaacctgatatctcctgcattctctgtcttgttccaccaactgaatatgtgggagtcatcctagattccctctaccttaaggcctgaattattgtaccctctttctctcactatgtcttccacatctatgggtttaaaacagaaatttgatcctcctaataccctttctcttaatcttataatggttcctcattgcatgtaagaaacttttttctccactgtcatgtacttcaatatctctaaaattgaccccttcctgttttgagcccctgaatctattttactggtttctgtggtaatacaaataacacaccactgacattgctgacctgtctccccttctactccacctaagctcctagagtgcaaagagtctatctttctgttcccatggtggttcatttatgatgactgaatgagtgaatgtggtttcagatttatggttatagattttattcagtgtgttcaacttgactggtttcctgtgttttgatatttctctgagtatggctttataaattcaatagtagtaatgagatgttttttatttatattagcagtggctttccattgaatattatgatttacctcatacttagttccttatatacattttaggagttgggaaaagcaaggtagttaaaatcatatcagaaaggaaccttactgttttttttgtgtctacatatagtacaataaaagcataattttagtatctttaatgtagatgtttgattagatattgaaacctttcaactataattagattaacagatctcctgctccatcctcattcccatttattagttgcttcctttcagactgtgatttaaagtttgagtgatgcgcctattctttctatagctaacagaattgttccaaagtgcagtgcagctgctactgaagctccttaggtcaatacatttttctgtaatagaaaaacatgtgtattgtgttttgtctccatagggatcttaaatctaatccatttaatttaaaataattttatttatctagaatgttacttaatattttgtataaaatatgcttattctaagaaaatgtttaagagttcttgtcagtgattattttaaaatgaaaacaggtaatgcaagaggcagctggacaatttttggatatatattgtctccaagttatatttcttcagaggaatgaataacaagtttgtttcccccgttactacgaactacacattatttttggagggaaataaaagggggtactgatgctttctgacatcaccctaattctctctatgaaaacagaaaccaaagcctcaagaatttgggctattaaaatgtaatatttgagctccagaaacctgttcttagaagtatgccgattgggatttatgtgaacttgggggtgggggaagaggggtggaaatgagatttcttaagaataattccattacttttgaggctgagacctagttcatagcttcaaagtatgattgggtttctcataattaattatctttttgctttcttgccccatgagggaagtctatagtaactactggatagaagtaattattgtaaaacatagttcaaagtcaaaatcttaatgactcctattaaatttctttttgatatgactttttatggaaatctgttaaatgtttgataattttcattatcccaaaataatgagactattatctgatatggcatactgtgtcagaggtcttcaagaccacttccaagtgtggtgatttgttaggataactcagagggctcagtgcatagtcctactaatagctttgatttatagcaacaaaaggaaaaggcaaatggtgcaaagaccaaggaatccaggctcaagctcccagtggagtcacacaggatgcccttaactcctccagtattgagttgtgacaacacatatgaaatgtcatatgccagggaagctcattagtgactcagtggccaggatttttatggaggcttgtcacatgggcagccttagcctagcacataccagatttccagactcccaaagaaaagtaaaccatattgtttgcacaatttaggcaaaatgagatattcttatcagggaatagtaggaactctcccaaaatccagaatcccaggggctagccaagggctaatcttgcaaggaagcttttctaaggatagcatctcagccctgttttattgtcttttcactgcatgtgcaatgtaacttgaatgcttataggtaaagtttgtctatcataattactgcagttttggaaggtggtcatacatccatgcctgtttgtgatggctaatatccatagtttgaaataaatataaacatggtcagttcagacttcaacacatcaagcatgttaacttttggaacagatgctatttttttttttaaatagaaataaaaaactgcatgttacaaaatgatcacaataggaatgaatatattgagactttttttttttagttcttcctgtgtaagttccataaatgtgtttaaattcagcaaacatttgagtgccactgtatgcctatttctgttctagatactagggacatagaaatgaatcaggcatgattcctgccatgaagaagcccatattctaagaaagatgacaggaatgtaaataaatatatgtttatagattagtataaggaacattattttgtcaaattgtattttttaagagattttaaaataagcttacttatactgctatttatgtgtcagtgtatattccacggacactgctatgtaatcttagggcttttttttaaaaaaaattttagtctcctgttttcttactttctttcttcttcttttttttatgagatggagtctcactctgtcacctaggctagagtacaatggtgcaatcagctcaccacaacttcggtctcctcagttcaagtgattctcctgactcagcctcccaagtagctgggattacaggcgtaagccaccacaagtggctaatttttatctttttagtagaggtggggtttcaccatgttggccagctggtctcgaactcctgacctcaggtgatccacccaccacagcctcccaaagtgctgggattacaggtgtgagccatcgcacctggcatagtgtcctgttttcttcaactctcttgatttttgtgctagagaaagtgagagagggcatgcttaattataaagtggtttatcacagtaagtcactgtgctggaacctatttaggctctccctacatcagccatcacaaacattttagtaactgcctttaagaaaaattttgccatagtgctattcattttttttttttttttgagacaaagtctcgctctatcacccaggctggagtgcagtggctcaatctcggctcactgcaacctccgcctcccgggttcaagcgattctcctgcctcagcctctgagtagctgggattacaggtgcccaccaccacactcagctaatttttatatttttagtagagacagggtttcaccatgttggccaggctggtcttgaacttctgacctcaagtgatccacctggctaggcctcccagagagctgggattacaggtgtgagccaccacgcctggccagttagtgctgtttttttttgttttttgttttttgtttttaagatggggacttgctctgtcgcccaggctggagtgtagtggcgtgatctcagctcactcagctctgccttccgggttcatgccattctcctgcctcagcctcctgagtaactgggactacaggtgcccgccaccacgcccagctaatttttgtgtgtttttagtagagacggggtttcaccatgttagccaggatggtctcgatctcctgacctcgtgatccacctgcctcggcctcccaaagtgctgggattataggtgtgagccactgcacccagccacagttagtgctattcttaatgtccagtacttgtagtagtcatattttgaattttatataaagctttatacaaaaagaaatcaattatcataatttcctgtttcccccatgcaatctgcctttttattcctgcctcttcttctgaaataactgaattattagtcagttttgctttctttcatttctccttttgatatgacttccttaatataatgagcttggaatttgctttaggtggttgttcagtttatcttctaatcatgtatcagagtcttctatcatgcccacagctccacaaaataactcaagaacctgagctctgggtgtggagctttactaactcttcttcccctttgctttaaatttttacactaacacgtgtattttttggtctgtcgtatatttatttatttcttttttgagacagggtctcactctgtcacccaggcaagtgcagtggcacgatctctattcactgcaacctctgactcccagtttcaagtgagtcttatgcctcaggctcccaagtagctgggattacaggcctgcgccacatgcccagctaatttttgtatttttagtggagatgggatttcaccatgttggccaggctggccttgaactcctggcctcaagtgacctgcctgcctcaatctcccaaagtgctatgattacaggcatgagccattgcacctggcctgtcatatacttttttataattattcatgtgcttatctttgtcttctgtcctctcagacgctgtgcttttttaccacaatttatacaaccagctgtgtgactttgggtaagttacttaacctcttaatacctctggctactcacctataaaacagagataataatactcacctcacagggaccttgtaaggattgcattaatatatgtaaatatcttagaatgatgtctccagcccacttgataaatgttatcttccccaactttttttaaaaattcaaaccttcaaaaatggtaagagtgaataagtatccacataccctttgcttgaactaattttttactttatgccaaattttccttatttctgtaagtgtgtgtgtaatttttttaaacgaaactacttgaaggtaaactgcatatattatgatacttcagcacatatctactaagagtaaggacattttcctatacaagcacacccaggaaatgtaagaaagagacaatgaaagtatttactatgcagtctgatatggtttggctgtgtccccagcaaaatctcatcttgaaatgtaactactacaattcccatgtgttgtgggaggaaattgaatcatgggagtggttctttcccatgttcttctcatgatagtgaataagtctcacgagatctgatggttttataaggggaagtttccctgcacaagctctcttttcttttctgccaccatgtgagacgtgcctttcaccttccgccgtgactgtgaggcctccccagccacgtggaactgtaagttcattaaatctctttcttttgtaaattgcccagtctctggtatgtctttatcaggagcatcaaaatggactaatacagtaaattgatactggtagattggggcactgctgaaaagataaccaaaaatgtggaagtgacgttggaacttggtagaggctggaacagtttggagagctcagaagaagacaggaaaatctgggaaagtttgggactccctagagacttgttgaatggctttgaccgaaatgctggtaatgatatggacactgaaatataggctgaggtggtctcagatggaaatgaggaacttgttgggaactggagcaaaggtgactcttgttatgttttagcaaagagactggcagcattttgcccctgccctagagatttgtggtactttgaacttaagagaaatgatttagtgtatctggtggaagaaatctctaagtagtaaagcattcaaggggtgacttgggtgctattaaaggcaatcagttttaaaagggaaacagaacataaaagtttggaaaatttgcagcctgacaatgtgatagaaaagaaaatcccattttctgaggagaaattcaagccagcagcagaaatttgcataagtaacgaggagccaaatgttaatccccaagtcagtggggaaaatgtctctagggcatgtcagagaccattgcggcagccccttccatcacaggcctggagaccgaggaggaaaaaattgttcagtgggctgggccgggatccctctgctgtgtgcagtctagggacttggtgccctgtgtcccagccactccagctgtgactaaaaggggccaaggtacagctcgggccatggcttcagaggttgcaggccctaagctctggcagtttccatgtggtgttgagcctgcaggtgcatagaagtcaagaattgagatttggaaacctctgcctagatttcagaggatttatggaaatgcttggatgtccaggcagaagtttgctgcggggatggggcactcatggagaacctttgctaaggcagtgccaaagcaaaatgtggggtgggtatgcccacagagagtccccactggggtgctgcctcgtggagatgtgagaagagggccaccatcctccagaccccagaatggtagatccacagacagcttgcaccagaaaagctgcagacactcaacaccagcccatgaaaacagccaggaaggaggctgtaccctgcaaagccacagggacagagctgcccaagaccatgggaacccacctctggcatcagcatgacctggatgtgagacatggagtctaaggggataattttggagctttaagatttgactgccctactagatttcggacttgcatggggtctttagcccctttgtttagccaatttctcccatttggaatgggtgtatttatccaatgcctgtatccccattgtgtctaggaagttactaacttgcttttgattttgcaggctcataggcagaagggacttgccttgtctcagttgagacatttgactgaacttttgagttaatgctgaaatgagttaagactttggggaactgttagaagacatgattggttttgaaatgtgaagagatgagatttgggagggaccctgggcagaatgatatggtttggctgtgttcccacccaaatctcatcttgaattgtaactgctacaattcccacatgttgtgggagagaccccaggggaggaaattgaatcatgggggtgggtctttcccatgctattttcatgatagtgagtaagtcttatgagatccgatggttttataaaggggagttttcttgcacaagctctcttctcttgtctgccactgtgtgagacatgcctttcaccttccaccatgattgtgaggccttcccagccatgtggaactgtgagtccattaaacctctttcttttgttaaattgtccagtctcaggttatgtctttatcagcaacatgaaaacggactaatacacaggctgtgttcacaatttcccaattgttcctaaaatttcctttatagctttttcctttttttattctttctctctctgtttaaaaacgtctaggaactaaacaagaatcacatttgctttagttgtcctgactcttcagtctgttaatttagaccagtcttccttccttttttcctgtcttcttgtgactttgacattttagaagactatagggcagtagcttgctttgtaacatgttcttttgaaaactgcacatactgattgaaagataacagactttgttaaattatatttcctctctgtggtcttcattgaactaaataattaaatgatagtaaaagtagccttcatttaatagttaaattatttaactattatatgaaataatttaactattaaatgaaggctacattttattatttaattatttaataactaatgtggtttaattaattaaactttaaagtttttagaagataaataaataatggagataatttgggttatgtgaaagatcattaaaaataaaatacatattggccaggtatgtaatcccagaacttcgggaggctgaggcaggcagatcacgaggtcaggagattgagaccatcctggccaacatggtgaaaccccgtctctagtaaaagtacaaaaattagctggatgtggtggcgcatgcctgtaatccaagttactcaggaggctgaggcaggagaatcgcttgaacttgggaggcggagattgcagtgagccaagattgcaccactgcactctagcctggtgacagagtgagactccatctcaaaaaaacaaaacaaaacaaaacaaacatattttgagtagaatattccaaaagattaggtttataaagaaaaaaattagaccaaaaaagttgttttatttgaaaaaggctttaaaaatatttcagtctcattttattaattctttaatatttattgagctcttgctaagttgttcctgttctcctaatgtttgaaatccagggagtgaggcaagctgttaggaaagtgtagtacagtgtgataaggcatgtgggtatatgtgatgaggagcttacagagtcctaggggagcaaataagaagggcagctaacttagaactgggagattagagagacctctccaaagatatagtatctgtgtatagacatattaatgtaggtataaaggtattatgagacaaccagacaaggggttaggggaagagtgttccagagaaaaggaacatcacatcccaagctctacgtatgagagagagagaacctaatatttgaggaatgtcagaatgacggtgggtatgcagtatggagaaggaactacagggtggcaggagaagaggctgaaagggaatgctggaggtcttataaaccacattaagggatttgaaggctactcttagctcaattggaaggttacctacaaaagtagaagtatgatataagcagatttgtactttaggaaaattggaaaacaaagctggtggcagggagtccagttaggaagctgttggctcaatcaggctaaagatgttggtgacccggattaaggtagtagtcattgaaatggagagaactgaatgagtttgagaaatatttgggagatggtatcaacagtatttggtgattgaagaagaggtataacatattaattaagaaaaagactgtagagcccagacatctgggttcaagtcctaagtctgtcacttagtagctttgtaaatttgggtcagttattaaacctccctatgcctcattctccccatctgtaaaatgggaagaaaaacagtactcattttataggattattgtgagaactaaaagaattaatatatgtacagaatttagaacaggtgccaggtacatagtaagtatcatataagtgttctataatagttattgttgcaattgttaatattattattactgatttgatatgtcagtgagggggagaaaaagagccaaggctaactcctagatttttaaaatggcagttgaggtgaattgtggcagattttatgtgtgtggcgggggcgggcagggaggaggtctgatgcattcacatttggatttgctgagtttgagaggcttttccagttggcatcgctcaataggcacatgaatttggaagtagggagaaagagttgaggatatcagtttgaaaattactagaatataggtgataattaagctgtggaaatagaatgaattcacccaaatgaagaactagttaaatagggagaaaggcatataaaagattgtgttatctttaagaatttattatttaggccagaagccaaagtataaaacttggtgccaaatggaaagtttagaaaactttcagcattcaatacaacttcatttaaattaggttggtcttcagaggatattgaggtgagtaaaatgggcagctagatgaaagaaaatcattcatctattgaggaaactgcagagaagtcactttgctaacacagggaagatgttgctgattattttctgttttggatctgacttaaggaaaaaagataaaagattcattcttaattggcagaatagcaaagaatgagttaagtctttctataaattatttgtcttaagtacctattgctagaattagttaatattgtatttactaaggaattctatattttttcaactattatgaaaattttcaagcatacagaaaattagaaagaacaggacaatgaatacccatataaccaccacttagattccatacccacctatctataagtatgtgtgtgtatgcgtacatgtctgtgtttagtgaaaccatttcaaagtaaattgcaaattttatgacactttaatcctaaaatatttagcatgtattccatattatacctcacaacaccactatcacatctaagaaaattgacagtaatatcttaatattagctactatccagtttatagtcaaattttcccagttatcacaaaaatattttttatggcttttttttcccttcctaaacaggatccaactgaagttgacatattgcctttaggtgttatacctctttagtctcttttgtttgaaaatcttcacctcccccaaccttttttttttttttttgaaaggaggagactttttaagagagcagaatgttctaaattctaaatttgtctgattgcttcttcatggtatcatttgtcttgttcatctatcctttgtaattcctataaactggaatgtaaaccaagttgattctattcagattaaatgttttggcaaaaatacttcatagatgacactgtaaacttcatattgtattgcatcaaatggctatcagattagcaataataagtttgatcttttctgtgtaataaaatacttttctcctttgagattagcaggaaattggtgggaataatttcatactaaatggcttagcatttattgatgactgaatcagttatttcatcgggagttgctaattctatcgttccttgtacattgttagctggcattcttaggtaaataagaattttgcacctggaaatgaacaacataattacttatttgctttatcctacagtacacaaaaataggtttaaaatgacaaaacccagtgttaatactataagcataatgtgaggttcaatatttttaatagtttttattgtccttagaatatatgccaataagaatgtaagtcagaatactatgttcaaaagtgacttgaaatattttttgttctcatgtggttatgttactgatttgacaagcaattaagttcatttgtttctacttgttttcggtcaaagtttgcttatttagatcttatatttagttttattctcttgaatttataaaacttttgttggttcagaagtcacactatattataaagtatagttggagaagtttggcttttattttgtacatctaccctctacctctgtccttttaccaccctgtcataggtaaacatttttattcatttctagtttagcctcctagtgtgtttctatgtgttgtgatataactgtgtaactgtccttgttaattagcgttgctataatgaaaattccataaactgagtggttcaaacaacaaacatttatttctcacagttctggaggctgggaagtactaggttgaaggtgccagcagatttgatgcctgatgagggctcaattcctagttcaaagatgtccatctttttgctgtgtccttatgaggcagaaggttaaggagctctctgggttctcttttattggacgctgttcccattgatgcaggctctgtcctcatgatctaatcacctatcaaaggccccacctcctcataccattacactgggggttaggtgtcagcatatgattttgggggaacataaatatttagtctgtggcagtactacaactctaactatccttattttttcttctatactggatgtatcatcttgtactccatagaggcatgcctagtatatttgatgcctaaagcagataactttttaatatatatctctcctatatgacaaaattattttcaaaaataaccatgaaataaaacaaaatataataatgggtagaaatgagatataaacattatattttattttattgaatgatgaatatataatcatgccaataaaaataaattaaaaataaaataaatattacagtacagaaaatgtttattaaaatattttcaccagaaaattcatcttaagtttttctatttgtttttttaaaaaacttctgaaagtttttctttttctggaaaatgcagagaaaatgactgtgtgatagtgggcattgatgctatttgacccactagtttataactgtgcattcaaataaacagtgccatttggtttcttctagtaatgtaaaagcagcatcttttgttgtttcccttagcattcttcacatttttgttcttttctcaatataaatgtccatttcctcacattttatttttgagtaatgaccatagccacagtttctatgtactgttctttaaataacagttttaaagctttatgttttattgtccattgttgaaagttgattccggctgtctgcaaacatttttgtgtctgattagctcatctaaaacttcctaccagaaaggaaaaaaaaaaaaaagacaacttaacgcaggaacagaaaaccgaatgttgtatgttctcctaagtgggagctaaacaagaatacatggacacaaacgggaacaacagacaccagggcctatttgagggtagagggtgggaggagggagaggattaaaaaaaatacctgttgggcactatgcttattacctgggtgaccaaataatttgtacaccaagcccccatgacacgcacttatataacaatactgcacatgtacccagaaacctaaaataaaagttaaaaaaaaaaaagacaacttagaaaagagaaacaaggccaggtgcagcggccttatgcctgtaatcccagcactttcggaggctgaggcaggaggattgcttgagcccaggagttcaagaccagcctgggcaacatagtgaaaccctatctctaaaaaaatacaaaaataagccctggtggtgtgcacctgtagtcccagctactcgcgaagctgaggtgggaggattgcttgagcctagggggtcgaggctgccgtaagctgtgattgtactactgcactccagcctgggcagcagagcaagcccctgtctcaaaaaaagaaaaggaaaggaaagagaaaaagagaaacagcatacactgatcattatttatttggaatatattatttaaatgcagaaatatatggtgtcataggggctagagacataaactgtactcaaaggaaacttgaataattttgaaacattacaaaattaacttctgaataaatgtaactgagtccatgtgcatcagaggctaaactgtgagttctccactttctttttttttaagttaattttcatatataaatcagtgtttattgagaaataagtaataaaaatctgctaatttaaagcttacatacaggttattaaaacttaacagtcactggaacaattatttagaatttagaacacaaattctttttcagggagtatttttatcactgacattgtttagaattgctggcacttgatgataaaaagcagaataatttttagttaggtttaatttttaagttctctatgtagaatgcacccccttgttgtgggcctcaagggtgatctgcttctaccaccctacctttggtatgccactgtatccactagcaaagtatgagactatctgtttcttcccaacctcaccaacagagtgttgttgaatgtttcatcagtctgatggtgagaaatcatattgttttaattagcattcatcttatgagtgaaggcttttataagtttaaaggtcgtgcatttctttttctataaaatgcctagtcatttattttgccatttgttttggtggtagtttttccccgactctatgtttgaacataagtggtattgcggggggtgggggtcgggtggggggctggggcggggacagggtacctttctcgaaaccttagtactcaacatgatacacaacagaaatcaccatgtctccctttaaggtggcttatgcatactgcagccacactaaggaactaaaacaacttcatatgtatgagcctaggaaactgttgaagtagagcttttcaaattggactcacagtttcatctgtttttatacattggaatttcttacacagtttcttttaagatataattcagttcttaagtctctgaatcactgctataaagtgagaacaaacatcagtggttcttttaaattttataatataccataatacaataagagctacataattagaaattagtaatttaaccaataaaatcagttaaattggtttcttcactgaattgagttaggcaatttaattaaaataattatcacataaatatagccctactgcttaaagactatttatactttgctaagaaagaaaaattgtatattcattttatagagtcaaatatgaatgtttgtattgcagttattaaacttttatattatatataaacagcttcccagaaacagaattgaacatgaaattttatctccatgtctgcaaattccctttcagtcagtatttatatatatattatctttgtctttatagtgttacctgcatgtttgtattggaccttttctacttttttttttaagttgtaaaaatggtaacaacatttaagacaaaagtgtaaagacagagcatagccactcataatcttatcactaacagctttttaattgtcagttgtcttattttttaatgtctcttctaaattgtcacatctgtttctttaaaaatcctgatctctaagaataatttctcctcagtggcactttttgcctactggtccctcttttaaatacgatagtattcttcaatagcaacaaaagtgtatttggttttaattttgaatttaaaatttaacaaagtatctcgtgtttactgaggttaaggtacttgtgaattatttattagagagcttggaaatgttaattttaagtgtatgtattgtaaatctgtctcatcatgtcaaaaacaaggtaatagaatcatgtaatatatgaagatgtatgttattaaagagctacaaagaattgatgttagtgcttacttgaacttacaacagactttttccaactgaattgagattaatttacatctctctagaaagcagtaacttctgacatccattcattttgaccatgaaaaataaggtggtgtgtggattgtacctctcccctgtatctattggtctcgttacctgtgtgccttgttttttctcatgtgacacctgtttattttttcatcacagtagctaaataacgtagtattagtatttgcctacagcagctctaagttatatggttttcttttagctttagtcatagacctccggattacttgtttcgtgtctctctgaagaaaaaaataaaagaaaatgtggtacatatacaccatggaatactatgcagccataaaatgaacaaaatcatgtcctttgcagcaacttcagtgcagctgtaggccattacattaaatcaattaacacaacaacagataaccaaatccacatgttttcatttataaatggtagctaaacattgagtacacatggatagaaagaggagagcaatagaccctggggtctccttcagggtggagggtgggaggagagtgagagtcaaaaaactacttattgggtagtatgctcactgtctgggtgacaagatcatttgtataccatactccagtgtcactcaatttacccatgtaacaaacctgcacgtgtatcccccgaacctaaagtaaaagttgaaaaataaagataaaaagatagatgaaatttagctatatatctattaatttaaaaccaccattaccaccacaactcagaaagaccttgttgccaagcgaacggaatacagataacacaccgtgtctttcatcacagagttttcatcttaatctcccttgatttggactgtttaaatatcttttctttttctttttttttttttttggaatcagattccccgtccccatagctaaagaatttaaatttgtctttatgatgctgttgtttttacctttttcttgggacacggtgaatattaatattctcatttcaatgtaatttctttttaatttttgagttttcttcaactgtgcttcttgtttattaaacatttagttcattctcttttctcctgcagggacacctataatttgaagtttgaatcacagcacttcccctgcacatctgtgagcattcattcacttcacgtctcagctaatttcttatgtttagtatgtttcttgactctgcctcctatttcaccaatacaattttctgctgcgctgattcttctaatgctgcttctactgccagtattaattggtttgtggctaaatttatcctgtgctgctgttagtgccctccaactgttctgcttttcccatagtccacattgttgccagaatgatccatctaaaatacaagtctggctatgtcatgcatcctggtaaaatatttagtgacttcaccacagagtaatgctctaatcctttaaggtcatgagttagatccttctttcatctgagcctcccgcctatcactctagtcatataatcccttgcggccttgcctttccttccatgccattcagcatgccctttctcctgcctggaatgcccactgtgctccctctatctatcctctccattcattcttccagtctatgttgcctggcttcccctaccagtcacaattattttctcttgggtacatactcctatgtaccttgtacatgcttcttaactggcttttgtagttatttgtttagactggtttatgatactataacactggggtgaccattatgacaccaaagacaggtattactttgtgatttttatatcccccatgcctagcatagtgcttggtattttgttttattacccttctgtcctcttcgttttatttattttaagggagaaagtaatgatcacctctatcatgtgatttttttttcttttttatgggaagtatttttattggaatcagactgtttaattgtttttctcctgtccatgttttcttgtacataatttactaatccctaagatgtggtcttaacagtaaattgccttaaatcaccatatggtattcagtcactgggtcagggtagaggaaccagttctgtaagtggcctgcaaaaggcccagttagtattcatttcagtaaccaaattacaggcttaagtcaaccaggactgacttctctagcttaattgtttggtctgaagcctgggatggtgctcagctttcacatgtgttcctagttatgcagctctgaaatttgaaagcaagctgtactcggccagggtggtcttattctcttgtttttattgtttgcctcaaagattatatttgctctaattcttaagcacttaaaagaataggggaaaaaacagaagctttatagatttctaaaaaatggtatacttttgttgttcgcttaaaaaaaaaacctctcaatagaaagttatgaagaggaggataaaaattcttcattgtcttgccactgagaaataagcacattttagaatatgttttgcatacacatataagaaacatgtaccaattttgtaaatattgtatactaaatgctattctgcaccttcctcttttttttaactcaatatatttaaacattataaatcagtagttgaagacacgtttcattattaatgatgtactcatcagttccctatagttggacacatttttttacatttgtatttgaatattaccttagtagatctttttctaagaggatatgcaagtatatgttaatagatattgccataatgcctttcagaaacgttgtgcaactgtatgccctcattaatagtgcatgaaaatacttattaccgcacatctctttcaaagctagattattgtcagttactctctgtgaggtaaagtcttccaatttccagccctaaattcagagctcttctctgaattccacatagttatatccaacaacctacttgatatttctacaaggtgtccgtctcaccaacatatcaaaacaacatgccccaatccaacctgatttcctgcctcaattctgaaacctgttcttctcctttctatttttctttaaatagaacttaaatttacctggtttctcaaatgagaaacctggagtcattattattttttgtctctgcctctctccctgaatcttcctgtcaaatgtaccaccaactattatggcttctacccacaatcccatgtatagccaaatacaagaagagcctgttcttaagctgtccacaattactagaagacatgtgtttttttttttttttaaaaaaatttgattagacagtatgaatctaactgttagggatataatcaaatttctacttctaatatttaatttaattatacatgtatttaaactcacaatttagagatacagggtttgccactgtgtcatacaaaaattttgttggtgctttttcaacactggaatgagtcatctaatacagttttccagatcatctcctcctcccttccatctaagttgtttgagataatgtattttttgaatctgtgtataatgctgtctcagttccaagtacaattagggcagaatttttccccctactttttctgttggcatatattcatgatcctgttacctaagcatggactgaattgcttttttcaaatgatcactgaaatattgcttgatggtgacatctaacacacacagcagggaggtaatacgtcatggaataattactaaatcttcttactttgcttacttttttctttttttttttaccagttgtgtcaaattatctcttgaagcaattgttgttggttccagctaacatgactgttccagagagtactttgtgatttttcagaacaaaataatttgtatgtcagtctgtaatctgaaatattctaaggttcaaatataagatgatttcctcttctaaggatagtttttgatattgaaaaactcttcatatatatgggtttgtacagtgaatctcaaatccatctccttttctccttcactaccactgtaaatcaaaatcatctcttacctggacagtggccctcactgtttaattgcaggccccatagctattcttgcccccctgtacattctccacacaaagttacttttttaatatgccagtctaattttcttacttctttacataaagcccattagtgctatttcttgactaccttttcagtttaccttggtacaacttggctcttaccattagcacatgaagtcttcagcttgatatagatagcagatagcctctatttagctattaaaatgcctgcattggtagtagtgggtaaggagggagctagagccgagggaacattttggtagctttatctccgtttctctatgaatttttgtcttttgctcctaggcattgggaatttttgctttccctgttgggagcaggcatggtggcttcatttggctccctctgcttcagggtgaactcatggtgaattagaaggtactctgccacagctcatacactttttgtcatgtactattccactctcaagttactgtcgtctgcagctttgaagtaggtttgcctactgacatcacacctcccagttaagaaccttgtacagaagaaaaatggccaatgagtttggccagtgagttccaccttcagtcctgccgtgctttctgatagctcacgtaaactggggatgtcagtggaggccttccggatattttctattcagagtttgcaaaacgtgctgtccttatgagctagagagttgcttgtcagcttttggcattccctcagtgtagtccaaattgttttgtattttctggagttgataacgtttttaagagataataaattttttctttcatttttgattattttttctcattttctgtgttgaaaagagggatttttgtaaaagtgacttatattgtcatgttgcctagaagactcttccagttcttgaacagacattttacattttgaaggatcattttaaaaaatattttaaatgtgttattgattaaagagagattagaaatggaaattggaaatacttaaattattttgtttgttgaatgtatgttgactctctctggactcagattacttttgatgtataatagaattttggggatctttaaccatttactgcagaaaagttctgagggtcagtatatatttttaaaagctatcagagaaaagaaaactattaaattgttcctttcatattggttaattatatcagcctactgcctgaatccagaggttgaaattgtttacaataatgaagtctcttaaaacacactatgaattctctaattatcatcttttttgggtcaatattccctttcagctgtctctttattagctgttgtaatgaaatatcagtaacagatcttccacctcaagtcttggacattctgttgaagtgcataactttgatttgtaaagactactaaacccagttattatgttttcagtgaaaatgacagtgcacaatagatggttttgtacgctcctgtcaaaaggatgaagcatataatatgactcagttattggtgtgccagccaggcattggttatctggcattacgacaggtttgctaatgattcctgatgtgagcgtcacaaagaaaaaattgtaaatagcctcaggataacacttctaaaatgctgggttttttttaagtactaaatgttcataatcccataaaaagtttagaaaagaaaaggacccaattttgattatttactttttcactttttctactctgttctgctaggaaggtcccatcttactttgcccttcctgatatatgaccttttaaggggaggttgtggtgattttgttgtgtcttgtctagaatgatgatttccatcttatttttcaaacataggttttagttctttagtttatccgttgactgagagtttcagttaaaagagaaatgattgcaatttatcctaggaatggtgaaaataatatttattttgaagacagctgaccaaagaaaagcctacacaaatagtctcagctttcatgtagaacttggaagttttttgtcataatggtccactatgttaggcctccttttccattaatgacatttaaagggcacaatttttcacaatttggtttccagtttgtaaaactttttttttcattatagtaacatattttcactgcagaaaatttgaaaaacaaaagctatgaagaaaaatgtttttaaagaaaaaagtttatttaaggccggatgtggtggctcactcctgtaatcccagcactttgggaggccagggcgggtggatcatgaggtcaagagatcgagaccatcctggccaacatggtgaaaccccatctctactaaaaatacaaaaattagctgggcgtggtggtgtgcgtctgtagtcccagctgctcgggaggctgaggcaggagaattgcttgaacccgggaggtggaggttgcagtgagccaagatcacgccactgcactccagcctggtgacagagagagactccgtctcagaaaaaaaaaaaaaagaaaaagcaaaaagtttatttaaaatgcttttcaaaatcacaaggtaattacatcctttgataataccttaagtattgttaagtatttaagaatgagtttgttttatgtgtgtcgcttacattttttttaattaattaatttattattattatactttaagttttagggtacatgtgcacaatgtgcaggttagttacatatgtatacatgtgccatgccggtgcgctgcacccactaactcgtcatctagcattaggtatttgcatatattcagttatgtttaatttggattcataccaaatattttattttgtaacttgctttttttcatttaaaatatatcatgagcattggactgcattgtcatatattgaagcattacttttttttttttttttgagataggatctcattctgttccccatgctggagtgcagtggtgcgatcatggctcactgtagcttcgacctccctggcttaggtgatcctccctcttcaacctcccaggtagctaagactataggtgtgcaccacaacgcccagctaattttttgtatttttaaaatacagacagcattttacccatctctacaaaaaatagagatggtctcggactcctgggcttaagcgatccacccatctcagcttctcaaaagtgctggaattacaggtgtgagccaccatacctggccaaaacattacttttaatgatgttgcttagtgaaagggtttgtgtgtctttgaagtctacagtaaaagtatttttctaatatgaatttattggaaacactatcagtataacaatcacattatttaaaatgtcatttttgcacgtttaagacaagcgtttatttagcactatgctagatattttggaggatacagagacacacaaaacataatttctgacttcacacatgcttaagatccagtgagggaagcagacacgtacccactgttctgtggcaagaaccaatggggaggagagatgaaaagatgaccttcttagtgtggactccagagttctgcccacgtcttgttttcagagcaggtggacaagcggtcaatgtgcaggtcttttgctttaaccttatttatgtgtacacagcactgtagatttatgtgtacacagcactgtagagcactagttagagtagacacaaaactgaaaccactagataaaacaattgggtgtggaggttagaagggtagagctgggtgttgacagactggtgtagttgcctcagaagtgagaatatagatatagatgcaatagcattttcctctggggcaccacctctttttctttacatctcagatccctggccatgtgtctgacagttttttagagaaatgattgttatttgtaaatacatcatacacagaaacacttgcttttttaagcaaataaaaatcataaaaacaaaaaaaagtccacagcatgatgggttttagttatacataatttgaatataagggagcaattttgatgctgcattaatgtggaattctacatgtgataaacagtgttagacttttagaatatatatttttagtttggtagagctcatggattttccagatgtataggctgcttaagccaaagagttctttctctagctatgattataattcttctgattataaatgcattaaaaaataataaaggaaggatgaagtggaggaatgtaagaaataagaaggaaggggagagagaaaagaaaacctttctgggcatgtgtaaggaaaccagcaggcttgaccttcaaatgccagtgatatgtaggacccagggcaacagatgaaatctgaccaatacatttgtgatggccccttccaggaacctatggaaagtggacactcccattttaatgtttactattgccataattcgtaatatagacgaagaatgtgacctttgttagcaggagcctttcttgtgactgctgaggtggtggctctattatgtagaatataataacattgcttcattgctttagtctgtttcttcaaactgtaacttgaaaaactgactagttttaaaaatggaaatggctcaagagactccagagtatttaatgcttttcacacttgggactggagaggaatttaattatataaattattttaaaaatccattaagttcctgcttgcctgtaacgagcgtggcatacttagagaaatgtgtagatataaaccttctgagtttaaaaccttggatatattcttttaagtaggagacagactagaaataatgagaaagcatttgaacacagatgtggaatatagaggtgaccagaaagaatatgttgatagttgttagcttatgggaattgcaaagggttttagtgtcagacctgagttagtggatgttcttttaaattattgttacaaggttctgcgtaacctactggtctatggaactcttatctcagattgtgtggactcttcctcactttctaagagccagcaacactggatttctctcagttcctctaaccactgtgttcttccccagctcaagtaagtgctgtcgcatgtcttgtttcctctaccaacatttcccccactgccctttttgccttgctggctcctatttatctttcagatttcagctacaatggcacttagtgaagtcttcccataactcccagatttaggatctaagttgtaaattcccacaatactctgtacagtagtccccccctccttattcttgggggatatgtcccaagaccccccagtggatgccggaaaccatggattgtaccagatcctacatatactatgttttttgatctaataacccagacagctactaagatagctactgagtaactaatgtgtgggtagcatgtatggcatggatatagagatgatacagcaggacaaagggatgactcacatcccaggcgggatggaacaggacggtatgggagttgagttcattgcagcactcagaatggcatgcaatctaaaactcattaattgtttatgtctggaactttccatttaatactttcagaccaaggctgactgtgggtaactgaaaccgtggaagacaaaacgttagataaagaggaactcctgtacttctcttttataatgtttccacgtttgaaatttcttcttcaatgtttatcttccctgcaagactttaagttccctttgggctcactctcattcactgcgtttagccctaagtacctactcctcagaactcagaaatgactagactgtgtcatggaaaagtaggctgttatgaaacaggaaacctgtactctataagcttatgcaaaagaagaaattcatcaaaagggaccatgtctcttacacacacaggtacatacgcgtgtgcacacacacaaacacacagagaaagagagagggagagagagaaagaaacagggatattctaggacagcgcttacaatgtttacagtgtaggctctgaagacagattgactgtgttcacatcccaggtctgtcacttactagcagtgtaaccttggccaagttacttgacttctcaatactttagcttcttacctataaaatgggaataataataacacctacttcaaaggttatcatgaggagtgagttaaaacatatagcatatactataataaatataattaatatgtatataataatgataataattctaaaataacagccctagtcatcagtgtttccatttcttgttcttgtctcattcctatgcctcttccacagaaagaagtgtttttggcttttcctgctgtagacttgttatacccaatggtgccagaagataatcgattcaaatggttagcttagccttattttatatttcagtccagataccattttgtgaatatgttttaaaatgttaataaataaagaacaaaatttgatgaattgacatataaactataattaaaacctactttaaagactcatagagcttgctgctttaatgaagaattgaagaaattgatgaagaatttattttagtgttttgactgagccaaaataaaatcagtttcattgttgaagaaacacagtttaacataaacttgtagatagactattaaagagtgctgtatcagttaagtgagcactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatctaaaaaaaaaaaaaaaaaaatttaaactgattaacttattctattttctaggtacacactaaatctataaaaactaaactaaatcaataaaaataaaccatggccttggcctttagatagctgacaatttaggtttaacaatgtatatggtatttttgaacagcttttgtgtcatagaatgaatatgttttactatgaaatgtatagatactgattatctagaaaagcattgtaaatacttttatttttacaaagaagtagacagtttgatttattattttttagggatccccttccttgagccagggagccagtctggcattaggctaatcttaccactttcatggaggcttcccttactgctatagatctcatgaggtagaagaagtaataagagggactgctattctgagtcctggtctaatggaaaaggactagtttgtaatattggttgtgtgttgatgtggttgtattgaacagtttattgggaaagtcaccaagttgtcttacagacatcattgtaaagaagagaactgaaacatggttatgcccatcctttgcctttaaggaaaacagatatttgcaagattatagcatctatggctgtgatttcaaggctagagagttctaaaagaaaaattattagaagaaattcttataggtgtacaaaatgccctgaacagctcaggtttcttaaaggatgtgcatgattaatagatgaaaggagcacataatcatcacacagttatacagtgctaagactttaagaaataaacatttaagaattttctcttcaaaggccaaaatttaaaaggaactaagatgcctcagagtgcacaaagagcttttaaggttgtgtttggagcaagagcaacaagagggaagagatagctcactgtctgaagaagatattcttaatgtctgtttacaggtaaaaatcagacctatacaattcttactttgcttctataatcttgcaatagcagaaatccttttcctatagtaaaaggtaaaacaaacaacctgaaacagaggaaattaaacaaacaaacaaaaaatatgagaagatggagtatcattcactttaaatgaatttaaattttcaatactgaaatgtattgcctcccaggagttgacggactcaggtataatcgtagggttattgtcacttttttttttttaacaaaatatagttttttgtttgtttgttttgttttgttttttttttacaaaatcactgagaatatggggtaaatacttggagacaagagagagacaaatgtcctagtttccaaaaaggaataaagtatattgcaaaaacccaagaccaattccctactttaaactgtggtaaaatttgaagagattgtaaaaaaatgaaatattgtgtttagaagagaatgggatgatcaccatgaatcaatatgaatttataagaataagacatgccaaaatgacctcattttttttttgctttatttttagttgtataattgctattggattagagaatagtaaagacatgttgtatcttgactttcgccaagtggttgacagtgtttccttaactatccttgtggaaacatgatgaaattagattgtaattagattgatttacagctgcttgcctggccattgccatgcccgcatgcccagcgtttagttaaataatagttactttatatactggttcctcacagagaactggtggtgaacattaatttgcatatattcagaaagtatggatttgtagttaacgagtttttttaaggatttgtatgttgaaacttgagttcctggatttattcatgattgaggtttctgttagggacttttttgcaaccaagctgtatttgtaagatatataaatctgtttttaatttacatatgtaaccttgacttataaattacttagaagccaaggcgtaatattagcatttagagcaaagtctggctatgttaagaatgctaacgttatgaagaatcttttctttgttcagtaacaactatagtaagctcacttggatgtttttcatacccttgaaatgtcattcctgtgaactatccctaaacaaaaggcagatgttcatatacaaattgataatacagatatattcagcagtgtctttctgagttaatgtgtctgttggccttctggtaatcccacagtcagctgcctgttcaagatatttacatattttttaaaaaaatacaaattccctggaatcatatcaaagagagaaccatatattttgttcacttaggaagttcttttggcagtccatgatggctgctacatccaatatattttttaattaattgttacttttagagaatgcaagtccatagttaacttattaaactttcataattgatatttctttgatgcttgtaatattttgtttctagcctcaaaaaagtgtgataacttttttgaatacttgcagatgtttacataaaatatcacatttatttatttgcttatttttgagacagagtcccactctgttgcccaggctgaagtgcagccgcacgatcttgtctcactgcgacctctgcctcccaggttcaagcgattctcctgcctcagcctctggagtatttgggattacaggcacataccaccacaccctgctaatttttgtatttttagtagagatggggtttaatcatgttggctaggctggtctcgatctcctgacctcaagtaatccaactgcctcggcctcccaaagtgctgggattacaggcatgagccaccgcacccagccaaaatatcacacttacaaaattgtccctcacacttttctttacaactgttcgtctcggtgttacatccagaatcccagtagaaatgaacggtgaaaaacagagtgcaattccagccttggcctctgagtcttaagatcttgtaggcccttaaaacaagaattgaggccaggcacagtggctcatgcctgtaatcctagcactttgggaggccgaggtgggcagatcatgaggtcaggagatcgaggccaacctggctaatacggtgaagccccgtctctactaaaaaacacaaaaaattagccaggcatggtggcgggcgcctgtagtcccaactactcgggaggctgaggcaggagaatggcgtgaacccaggaggcggaggttgcagtgagccaagattgtgccactgcactccaacctgggcgacagagtgagactccatctaaaaaaaaaaaaaaaaagcaagaattgagttgtttcaattattttgccttaagagacccattatgctgtaatttatgattttattgtggctttgtccttaattatatctaatttaatggttgttattttatagattaaaatgcaatctgagtttttagcattttatagttatctttgtacgttataccatatctgacagtaaagcttcaaatttaaaaaaaaaaggaaatcgtgagttaataaaacaaagtattgagtcagattgtctttttaaattattcatgtattatcttttatccaaattaagtctttttctgaaaatatgttgtatagcagatatttagatgtcggagcctacattatgttgtttttaagtgggggaaaaaacaatgatgcattctctgtccattcaaaaaccctaaccaaacttccccaaatatcacaaaacacctttagacaactatatagcgatctacgaaaacttttgtataacatttacaaaacatttgagacatctcttacctgattttaaaaatacttaatgaattcattatttggtatatttttgttcaataagtaatgagactatacagtattgattataaattagcattttattctatccggtgatgaatagtatactgtatgattctgtattatacatttaaaaaatgaaataatattatttttatctaaataaggcttgggttagtgggatccctaaatgcttaatagaaacaacctctgggaccagagattcttctgtgttcatcctggtaaatatctttcaggtttattaaaatcacaaaggctcccccttgctcagcatctatttttagcaagacaaaagaaggactttttagggtttgtgtttattagtttaggatctgaatatgtttgctgaacttttgacatacactgatttcctgcttatgttaacaccgtcttgcataggttatgttcatttatacatatgagaagagcaaaagagggagttagaaatgtaatattgtggaataatagttaaaaaaattagctgatcaatagtatttggtttatctaagcttgtcataagtgcgttgctctaaataaaagagtatactttaatcaactgttcttattcaataaaataatctattttgccttagcattgattttttctaattatctgaagccttgtctaatgaacaatggtttggactgtttggagtttcattttaagttcaacccttactataaattcattgctatcagatttctgcaatcctgttttttctgcttaatatttctttgagagcccttatatctctctatttatttcccattttccccacaaataatagaaaatttttgactttcttaattattcacattgtatctaggagtcaagcaagtggacagaaaatgcctgttcaatctagtgataggaagaggaccctaaggtagggccagtttggccttttcgaagatcagaaagatggccaagaataggtggagcagtgtttgacagtgggaagagtgaccaaattaggatcagggatggctggagccagaacatgtagggccttctagtccctgttcgggattttagattttgttgcaagtataagatatctgaggggaccctaaacagagtagtaattatcagatttatgttttaaatctcactctggcttctaagtggtgggcagcaggaaggagacaagaatgatgccgattagaaggctgggacagaattccagatgaggaatcagtggtggcttagattagggtggtggcaaatgaaatgaagaaaagtcaaatatgtcttggaagtagaaccgacaaaagttgctaatgtgttggatctggatgggtagaagtgaaaaggagaaatcaaggatgacttctagatttcgagattgttttgcaagttgatggtgccttctacaatagggaaaatgttggggaggaaacattgggggcagatggaattaaaagttctgttttggctatctgaaacttgaggtgcttatttgacttccaaatatatctgcaatatatatgcatcagtttgatgagtttagagcttggcagaggtagatcaaggatggatacatgatatgaatgtggaagttatcattatatagatagtatttaaagccatgggactaaatgaaattactctgaatatttttgtcaccttctctgacctgtaccttctccctcccttaccatgtaaaattattcccacattatattgcaggtacatattttaattatagtacctataaataatttggtgttcttttctttttagtaaaattctctgatttctttatcctgtttatagctaactggtttaagagtattcagttactagcttctatatttaagtgaacgtctaaaaattatgcatttattttctgttttttttttttgtctttgctccaggcaaagtcattaataaagatttgcggcattacctaagtcttcagtttcaaaaaggatcaattgaccacaaactgcagcaagtgatcagagataatctctacttgagaaccattccatgtaagtatgtgatggaataaaagaactgaagcagaaatgtcctttcttaactaattaaacatctacagatagtttgatggagtatttcacatgaaattgtgaagactaagttgggaacaagaatgaaacaaaaattggataagaagaaaaattttcaaagaacttgagaggttttgtttttaaaagtagaaaaatggaaaaactgggccgggtgcagtggctcacacctataatcccagcactttgggaggccgaggtgggtggacttgaggtcaggagttcaagaccagcctggccaacattgtgaaacctcatctctactaaaaataaaaaaattagccgagtgtggtggcgggcgcctataatcccagctacttgggagactgaggcaggagaatcgcttgaacccaggaagaggaggttgcagtgagccgagatcatgccactgcactccagcctgggtgacagagcgatactctgtctaaaaaaaaaaaaaaggccgggcgcggtggctcacacctgtaatcccagcactttgggaggccgaggcggacggatcactaggtcaggagatcgagaccatcttagctaacacggtgaaaccccgtctctactaaaaatacaaaaaaaaaaaaattagccgggtgcgtcgcaggcgcctgtaatcccagctactcaggaggctgaggcaggagaatagcgtgaacccgggaggcggagcttgcagtgagccgagatagcgccactgcagtccggcctgggtgaaagagcgagattccgtctcaaaaaaaaaaagtagaaagtagaaaaactggaagattctatattgtgagttttaaaaagtgatgactagaatttaagattatataatcccagcactttgggaggctgaggtgggcagatcacctgaggtcaggagtttgagactagcctggccaacatggtgaaaccccatctctactagaaatacaaaaattagccgagcatggtggcaggcgcctgtaatctcagctacttgggaggctgaggcaggagaatcgcttgaacctaggaggcggagattgcagtgagccgagatcatgccgttgcactccagcctgggcaacaagagcaagaccctcaactcaaaaaaaaaaaagaaaaaaacgaaaaaaaatatatatatatttttacatgttgttaactagattttattcctgtaaatcaatttgtaaagccttatgcagtaagaagactttttagctcccagtgccttgcataccaagaacaagtattttattagaactttattttaaaataattttaaaatctttcccttccccaacaagaaaaaaaaaaaagaagaagaagaaaaaggaaagggactctctcttacttggaataatttcttttttccctccctccgtggcttcttcccttcctcccttgactatgtagtggcaaagagctaagtaaaattgagttcaaaatctttactctagcatcttactggctactttacttgggcaagttacttaatgttcctgatcctcagaaactctctatatagaattagaataacaagacttacctcatatagctgttactaggatttaaaatgagagcatatatgtaaactgcttggcctagagaggcactcaagcagtgtttgtccccttcccccattctaactggatctcctccctctcatttcacctcgattcaatcagtttttaaagtgcacatttctcagcactataggaaagggaaaaaaatttaaaaataaagtggacatctgattcttgtccaaaatctatagtttatccttcaaagatttctactgacaaagttcagactccttagcatcgcataaaatattttttgtttttttaatctgcctccttatctatgatttcctcctacaaatctaccttgtagctgcagattgtaacttctgcctttatttcaatttgtatttgcctgatgtgtctttgtccatcttgttattcttaaagtctctgaatctctgttttacaaatagttctagactttactcagtagccagtgtgaaacttcttaaatttttattgatgtgatcaatatctttagcctcagttctgtcatggtttttatatttaccatatataagccttttgtatgaaaagcttttcactgtgtagtcattttatttgatctctttttaggaaggtttgtagggatcttttttttaatggttaccttgatacctttatataataatctttgttcctccctccctatttttttgcttctgtctctactatgagtaatattaaaattacttagtcatctcttctttttccttccttctctcccatcatctgacttgaagtaatatctttttattcctacgaaatataaggtaatcagtaaatgtatcccacactttgctgtgcttttctcattcttaccctactttttttgatagttgggctgttgttctacattggctaagcaaatagccattacattactgtactttcctcctttataattatcatttatcttttattctgtgggtaaatacatatttaatataaccaccaatccttatgttgttatttttcactaattgtagttgtctaaagctttttctttactcgttttcccagcaaaggctcacaggatcatcttaggagtttgtttgtggcctttatactttgatgtttgtttggatggatataaaatttttgactcattttctttccttgactatcttaaatatattagtcaactatctaactgtttttggcataaagcattgctcttaaagagtttggtagcaatctaattttcattcctttgtaagtaacttgatattttgcctgcatgggatgtctcatttttagtttcatagctctagagcttcctcttcccttgttaaaacaagataataaaaatatgtacttgtactttctaagataggtcttttttttatactgccctctgccactttcacttaagtttttcttttaattttattgttccagttttgcagtttcctcagtgtgaggtttttatcctagaagggagctaaaatttattttgtttcatttcacagggtccaagcagctgtagcccttttagatctcaacaggccctcttaacttacacaaaaattgaagtgtccaaagctccctctaggaacctagacgcaatgacacatcagtagcaggtagcatactgaagggtcacatgtgatctctaaatatcatactttcctaaaaagtttgaggtctccttggagatagttctgattctaggtctggtacaaggaaagtacaagatgagctttggagcatataagtgtatcagaaagtatatagtgcttaaaacattatagagacatatcagaaggacatagaagccacctagaaggggtgcttgatacttactccaaaaatctgaaacaatttgagcaacaacgttgaaaaaagagggcacttctattattgtcagatattgagctgtaggtggaacaggactatgatccttgagagaagaagaaaggagaccacacacagaggaatcctataatttcctcaactttctacttagaggcactttctggaccacagcacaaggagggagagtccaggcagagtacaatggactctgagttgaagggacagaaatctgagttcaagaagcctgaggtatctggaatttgcaggacagaatgtcacagaggagagggctatgaagaaaaagagctcaagcaatctgtaaaggcacccccttgactctgtggctgaatactaagctgagaatatgtaggaccagactcttcaaggttaaaccaaaaaatctctcggagttttaagtttaacaattcccagagcttacccaggggccaggagacatttgagttctaatcagcttggtggaagaatcccataagggtcctcccttactagcagggctaaaatagtcagataaagctcctctaggcctgctttaacaaagcttaattaagcaagaccccaaaggatcaagtgaatatgcatgcaacttaactgctagcaaaaaaggaagaaagaaggaaagaagtaaatcaacactctttaaagaaagatagtgtctgggctcagtggctcacgcctgtaatcccagcactttgggaggctgaggcaggcggatcatgaggttaagagattgagactatcctggcctacatggtgaaaccccatctctactaaaaatacaaaaattagctgggcgtggtggcgggtgcctgtagtcccagctacttgggaggctgaggcaggagaattgcttgaacctgggaagtggaggttgcagtgagccgagatcgtgccactgcactccagcctggtgacagagcgagactacgtctcaaacaaacaaacaaaaaaatagaaagacaacaaaatggaaacattgtgtaacaaaatattcagagtgtccagcatctaataaaaaattactagacctgcaaaaagcaggaaaatgtgacccataatcaaaagaaaagtcagctgatagaaaaaagaaacagaaatgacacatgatggcattactataccaggagttttagttattagaaatatgctcaaggatttaaagaacagtatcaacataatgaagagaaaaattatatataaatattcatatgtgtgtgtgtgtgtgtgtatgaatgaagtggaaccttaaaaattcactgaatggactcaacaggagattcaaaactggagaagaaaagatcagtgaacctgaacacgtagcaatataaactaatgaaactgaagcatagagaagaaaatgactgaaaaagtgaacttttttttttttgagcaaccagatgacaatggggaggggagagatttctacttctgcaatgaagtaccagtaccataactagtactagatttacccttttgtaataaagaactggaaattggacgaggaatatgtaacagctgttttcagacattgaaatacaggcagaacaggactatgatgcatttatatttacccatgacaaactatcaagccaaagtggaggaaggagaaaaaaaagaaatagtgactgaaatgtttccaaatttgatgaaaataataagtgcacagatctaagaagctcaatagatcccaagcagaagaaatgtgaagaaaaccatatcaaaggacatcataattagattataaaaaaccattgataaaaagaaaatgatgctgggcatgctggcatgtgcctgtaatctcaacacagcaggaagctgaggtgggaggatcacttgagcccagaagttcaaatccagcctaggcaacatggtgagaccccatctctaaataaagtgaaataaaataaaaatttttgaaaaagaaaatgcaaaatacagaaaaaaaagataaattacatgcaagggaacaaagaatgactgcagtatccacagaaacagtataagccagagtccatcaaataacatctttaacatgctgcaaggaaaaaaaaaaacgccaacctggatttctatgtacaacaaaaatatccttcaaaaatgaaagagaaataaagaattttcagacaaaaagtgaaagaagttttcagcagcagatatacactgtaagaaatattaaagattggacaaaatgcacaaacaacaaacgaaatgttaaaggaaattcttcaggtggaagagaaatgatatcagagcaatagaactgaaaggaaaatagacaactttataattacagttcaagatttcaacatccccttttagtaattaattttaaaattaagtaaaacatcagtaaggtaatagaaaacatgaacagtattttcaaccagcttggccgagttactatttattagaagatgccacccaacagcagcagaatacacatgctttcctagtgcagatgatacatttacaaatatagaccatattctgcaccacaaaacaagaactgatagatttaagaggatttagacttaaatcatatgaaacatgttatctagccatcatgaaattaaattagaaattattaacgatggtgggaggattgcttgaggccaggagtttgagaccagcctgggcaacataccaggaccccgtctctacaaaaaaaaatttttttaatgaggcaggcaaagtggcacatacctgtagtcctagctactcgagaggctgaggcaggaggatcccttgagcccaggagtttgaggctatagtgagctataatcatgtcaggaatgagaccctgtctcttaaaaaaaatagagaaagaaagaaattactaacagaaagatattcagaaattaataattaatagcacacttctaaataaactgtgagttgaataaatcacaaaggagattacaaaatattacacatatcaaccaacaaattgaaatgtatcaaacacaatatatgaaaatttgtaggttgtagctagagtagtatttaaatggaaacttacagtattaaatacttatattagaaaataatgaagatttcaaattagtgatctaaaattctaccttgagaatcttaaaaagaaggaggaaaatacttattttaagtagaaggaagaaaataataaaaagtagaaaccagtgcaatagaaaatagaaaaaaaccaatgaaatacaaagctcattctttgagatcaataaaagtgataaacctctagctagactgcttaggaagaaattaagcacaaattagtgctatccggaggccgggtgcagtggctcatgcctgtaatcccagtgctttgggaggctgaagcaggaggattgcttgagtccaggagtttgagacaagcctgggcaaatagtgagactctgtcactacaaaagaaaacaatatcaggaatgagagaggtgacatcactgaaaatcctatagatgttaagtgtgtaagtgtatgataaagattttttttttttttttttttttgagacagagtctcactctgtcacccaggtcctggaattcaatgatgtgattagagctcaacttccatttcttccatctcctgggctcaagttatcctcttgcctcaacttcctcagttactggaactacagatgtgtgccaccatgcccagctaatttttttttaattcttattagagacgacatcttgctatgttgcctaggctggtctcaaactcttgagctcaagcgatcctctggccttggcctcccaaagtgttggaattacagacgtgaggccccacacccggcctaataaggaatattctgaataactttatgccaataaactcaacaacttagatgaaatggacaaattctttagaagacaaaaactaccagtgctcactcatgaagaaataggtgagctgaaaaatcctctatctattaaagaaattgaattttagtttttaactttcctataaagaaaactttagcagagaggggtaggcaccatctctgctgtttggtcgactcagccattccagcctgcgggctttggagagtccaaaagtttcagacaagggagcgtccccccagcagcacaacatagtggctttgccagatcatgaccagactgctgctttaagcagcctggatcacttccttctcactgggcagggactcccagttgggcccttcagccatgcccactggcacatactatggacagagctctgatctctccctgggatggagtgccccagggaggggagggctgccacctgggttggatggatgactcaactgttccagcctgcaggctttggagagtccaagctgatgggcagaagtggttctccaccaggacacagctgttttgttgaggtgtggccagactgtttctttaagcgggactctgatccgctcctcatctcagctgatcctcccagctggctcttcacagccagggcctccagccaccacccatgttctatggaactgacagagctccaatttctccctgggacagagtgcctgaggggtgggcaagctgccaccttggccgtttgggctcgtcaacgggtccaacctgtaggccttggagagcccagaccaatagggagctgaagggatccccaacacaacacaacacaactcctttaccaaaaagcagccacactgatgccattcgtcctgactgggtgagacctccttactggagtatccagccacctcctacaggtacgttcgggctggcagtagttcagtacccacctgggacagagcttccagaggaagcagcaagctgccatccttgctgttttgcagacttcactggcaatacctccaggtacaggaagaaccaaggcaactagggtctggagcagacccccagcacgctccagcagccctgcagaagagtggccagactgttaaaagaaaaacaaacaaataaacagaaaacagcaacgaagaaaaaccacaaaaaccccatccaaagatcagcaacctcaaagatcaaaggtacataagcccacaatgatgagaaagaatcaatgcaaaaaaagctgaaaactcaaaaagctagggtaccccctctcctccaaatgaccacaacacttctccagcaaggtctcagaaccaggctaaggctgagatggctgaaatgagagaagtaggctttagaagatggttaataatgaacttcactgagctaaaggagcacattgtaacccaatgcaaagaagctaagaattatcatagaacagtacaggagctgacagccaaagccattttagagaggaacataaccccctgttatagctgaaaacacactacaagaacttctcaatgcaatcacaagtattcatagcagaataaaccaagcggggaaaagaacctaagagctggaagactggctttctgaattaagacaggcagacaagaataaagaaaaaagaatgaaaatgaatgaacaaaacctccgagaaatcagggattatataaagagaccaaatctacgactgactggggtacctgaaaatgatggggagaatggaaccaagttggaaaacatacttcaggatatcatcaaagagaacttccccaacctagcaagacaggccaagccaacattcaaattcaggaaatgcagagaaccccagtaagatactccatgagaaaatcatccccaagacaattcataatcagattctctaaggttgaaatgaaagaaaaaatgttaagcacagccagagagaaaggccaggtcacatacaaagggaagccaccagataaaaacagtggacctctcagcagaaaccctgcaagccagaagagattggggccagtagtcaacattaccaacccagaatttcatatctggccaaaccaagcttcataagcaaaggagaattaatatcctttacagacaagcaaatgctaagggaattcattactgctagacctgccttgcaaaagcaccttaaggaaacactaaatatgaaaaggaaaaagcatcattaccaaccactacaaaaatacactgtggtgcacagaccagtgacgttatgaagcagccaccataaacaagtctgcaaaataaccagctagcatcatgatgacaggatcaaatccacacataaccatgctatccttaaatataaatgggctaaatgccccaattaaaagacacagaatagcaagctgtataaagagtcaagatccatcaatatactgtcttcaagagacccatctcacatgcaaagacacacataggctcaaaataaagggatggaggaaaatttatcaagccaatggaaaaaagcaattctagtttcagacaaaatagacttcaaccaacagactttaaaatagactttaaactaacaaagatcagaaaagtcaaagaagggcattacataatggtaaagggttcaattcaacaataagagccaactaccctaaatatatatgctcccgatacaggagcacccagattcataaagttccttttttttgtttttttttgagagggagtctcactctgtcgcccaggctgaagtgcagtggtgcgatcttggctcactgcagcctccgcctcctggattcaagcaattctcctgcttcagcctcctgaatagctgggactataggtgcccaccaccacacttggctaattttttgtatttttttggtagagacagagtttcaccatgttggctgggctggtctcgaattcctgacctcaagtggtctactcatcttggcctgccaaagtcctgtgattacaggcatgagccactgtgcctggccataaagcaagttcttagggaccttcaaagagacttagactcccacacaataatcgtaggagactttaacacccactgacaatagtaggcagatcattgagacggaaaattaacaaagatattcaggacctgaattcagctctggatcaagaggacccgatagttatctacagaactctccaccccaaaacaacagaatatacattcttctcatcactgcatggcacttagtctaaaactgatcacataatcagaagtaaaacactcctcagcaaatgcaaaagaactgaaatcataacaatctctcagaccacagtgcaatcaaattagaaatcaagattaagaaattcactcaaaaattagttgagtatggtggcacactcctgtagtcctagctactcggggctgaggcaggagaatcgcttgaacctgggaggcagaggttgcagtgagctgagattgtgccactgcactcctgcctgagtcacagagcgagactccatcttaaaaaacaaacaaaaaaacaaaaacaaacaaaaaaaaccaaaaaaacaataaaacaaaaaaagaaaaaaggaaagaaagaaagaagttcacttaaaaccatacaactacatggaaattgaacaacctgctcttgcatgattcttgggtaaataatgaaattaagacagaaatcaagaagttctttgaaaccagtgagaacaaaaagacaacacatcagaatctctgagatacagctaaagcagtgttaagagggaaatttatagtactaaatgtccacatcaaaaggctagaaagatctcaagttaacaacctaacatcacaactaaaagaactagagaaccaagagcaaacaaaccccaaagctagaagaagacaagaaataaccaagatcagagctggactgaagcagacagagacatgaaaaacccttcaaaaaatcaacaaatctaggagctgggtttttgaaaaaaataataaaatagacttcaagctagattaataaacaagaaaagagagaagattcaaataaacacaatcagaaatgataagggggaataccaccactgaccccacagaaatacaaacaaccatcagaaaatactataaacacctctttgcaaataaactagaaaatctagaagaaaatggataaattcctggacatatacaccctgtcaaggctgaaccaggaagaaattgattccctgaagagaccaatagccagttctgaaattgaggcagtaataaatagcctaccaaccaaaaaaagcccaggaccagatggatttatagctgaattctaccagaggtacaaagaggagctggcaccatttcttctgaagctattccaaacaattgaaaaggagggactcctccctaaccattttatgaggccagcatcatcctgataccaaaacctggcagagatacaacaaaaaaagaaaacttcaggccagtatccctaatgaacatcaatgcaaaaaccctcagtaaaatactggcaaaccgaatccaacagcacatcaaaaaacttatccaccacaatcaagtcagctttatcccgaggatgcaaggctggttcaacatacacaaatcaataaacgtaattcaccacataaatagaactaaagacaaaaaccacgattatctcaatagatgcagaaaaggcctttgataaaatttaacaacccttcaggttaaaaattctcaataaactagatattgaagaaacatatctcaaaataataagagccatttatgacagacccacagccaatatcataccgaatgggcaaaagctggaaccattccccttgaaaaccagcacaagacaaggatgccctctttcaccactcctattcaatatagttttggaagttctgaccagggcgatcaagaaaaagaaagaaagaaagcatattcatataggaagaggaagtcaaactatccctgtttgccgatgacatgatctcctatatctagaaaattccaccgtttctgcccaaaagcttcttaaactgataggcaacttcagcaaaatctcagggtacaaaatcaatgtgcaaaaattgctagcattcctatatatcaacaacaggcaagctgagagccaaaatccagaatgaactcccattcacaattgccataaaaaagaataaaatacctagaaatacagctaacaagggaagtgaatgacctcttcaaggagaactacaaacgactgctcaaagaaatcagagatgatgatggctgagcatggtggctcacgcctgtaatcccagcactttgggaggccaaggcgggcagatcacgaggtcaggagatcgagaccatcctggctaacacggtgaaaccccgtctctaccaaaacaaaaaaattagccaggcatggtggcgggcgccaatagtcccagctactgaggaggctgaggcaggagaatggcatgaacctgggaggtggagcttgcaatgagctgagatcgtgccactgcactctagcctgggagaccgcgagactccatctcaaaaaaaaagaaatcagagatgatgacacaaacaaatggaaaaacattccatacttatgaataggaagaatcagtatcatcaaaatggccatactgcccaaagtaatttatagattcagtgctattcccattaaactaacattgacattcttcacagaattagaaaaaaactattttaaaattcatttggaacagaaaatcagatgttctcacttataattgagagctgaatgatgagaacacatggacacatggtggggaacaacacacactggggcctgttggagggttgcgggtgggaggaaggacagcatcagtaagaatagctaatgaatgctgggcttaatatgtaggtgataggatgatctgtgcagctaataccatggcacacgtttatgtaacaaacctgcacaacctgtgcatgtacccctgaacttaaaagttggaaaacagaaaactttaggcccaggtgatactggtaaattgttctgaatatttaagaaagaaataataccaattctacacaaactcttctagaaaatagtggagggaacatttcccaactcattctgtgttgtgaacatgattctgattctaaaatcagataaaaatattaaaagaaaatgttaggctaaaatttttcttgaatgtagactcaaaaattcttaacagtattttagcaagtcaatatatatagcaatatgtaaaaggataatacattatgatcaagtggagtttgtttcaggaatgccaagttggtataacatttgaaaattaatatagtaatattagaaaacaaaaaccaattaattttttcaatagatgcagaaaagttatttggcaaaattcaactcccatttatgacagaatctgtcagaaaactagtctgccatttattacccattgcctcttggctataaatctacttttttgcctgcttgtgatactgtaacatttgtctcctgtccattggcacagtgttaagctttcaatagcgagcacagaaaggatactggagaaagaagagagttcttttcctggttccagtgtgtctttttctttttgctcctgctatccaaaaagacacccagcaagtttcagcagtaccctagcagtcagcttccctgtgacaagttcagtggcacacctgcaggagacttccttacagcaagttcagcaacaccctgataggtgatttcatgagtaccagcagtgcaccagctgacttatagtttcctggtgagttctgtgacatcccatttggtcccccagttttcagcaacatcctctgagaaccagttttcctatgggtttctcgcaagtccagccaatgtcttagctggttttctattcacaaacctcactcaccaccataggtagcttgctggcgaatttcactgataccccatgcagtttcctgcctgttaaatccctgacccactaactgtgaactagctctgtcctcaggcaacccaggaaaattccccaccatccagtgggctgttaccataccctcttcaatgaggtctaaatcccagaccttgggagagtccctcccttccaagtttgttccttatttaaatattctccctcagctttagggtgatattctttagagtcctcgtttattcctacttagttaattccctgtaaacagttaacaattctgtatattaaactgtctctgttcagattgccatgtggtttctctctcttctctggatcttgatacagaattagtactagtagcgctcccaggagacagaacctctaagaagggatttcagaattggttttggttgtcttggctgatcttacgtggagtgccaagtttcttccaatgagaggtgggatgctgataattcatgagaagccatggcatcacaatttaattacagtatcacttatggttgattgtgaagaaatgacaaatgaacccagtaccttgagagcccaaatgactgctgcacttgactgttatggcagtagttatggctacgaacactgtagtttaggatagattctcctgtgtggcaagtgcttacagagagaaactggcaagataaaatcaaatggtttactattgttgttattattatgaactaataaaataagattttgttactatttttcaatgatctctacttgatacagatgtctgataatagaaaaacttaaggagacattggttgggcatgttggctcacacctgtagtcccagcactttgggaggctgaggcggaaggaactcttgaagccaggagttcaagatcagcctgggcaacatagcaagactgcacctctaaaacaaatgaatgaatggaagcattaacacaaaataaataccaaataaaaatcatttaaaatttgaaagataatcacatacgtatttagtatttgaatttttcatacctaaaattgtagttatttatttatttatttatttttgatttatttatttatttttgagacagagtcttgctctgttgcccaggctagagtacagtggcacgatctcagctcactgcaacctccacctcccaggttcaagtgattctcctgcctcagcctcctgagtagctgggattacaggtgtgcgccaccatgccctgcaaatttttgtatttttagtagagatggggtttcaccatgttggccaggctggtctcaaactcctgacctcaggtgatccgcccgcctcagcctcccaaagtgctgggattgcaggtgtgagccaccgagcccaaccctgaaatgaaattttaaagcacaaagtatcaattgttttatctgatggtcttgatctttgtttggtgataaatatgccagaaaaaaatgtatttcattttgcactgacattcatcaaattattaagaatgtatccaaaaacatcctcatatcgggcattacaaagtatgttgtttcatgtaatctcattttcttttttaattctgaaagcatttcgtctgcttctcctgattttgattttgccgttgaaatctattaaatatattgcttttatttcagattttagatccgtttcttatttcatgttggaatgttccacaacagcattcactttctctctttgcattttttctgttaaatatttacaaagcactgaagcttgtaacaaataatcagtgaaaaatgccagaaaatattattggatagtattcaaataacctaacatttagatttctgagcatggttaacagcattacacagagttgtgtgttgaaactgccaatttaaggacttacttagcctccaaacttgttatttcttggaactcaacttataggatttatatgaagtataatatacatatcatcttattagtattgttttatgtaagaaagacccaccactagcagatatggccatgagcacacacttgtgggaacagctgcaagtaagactgacttgagtgtattgtgactactactctcccacatgcttctgtcctggttcctggaaatatcaaccttaacctttgattctgcctttcagtgtttcctgctcttgctttcatttgatatcagctgatttcttcaagccagatgtctctatgtcaaattattaaactttagtttgtgcaggagaattagaactttttttgtcatttttcatatcaactgatttgttgtaaatttagagaaagcaaattaccctagaaactccagaaggaattcctacttagtaacataaatcaaccgcagctctcatatattgcaggtgggaatgcaaagacatctactttggaaaataatgtgatgttttcttatcaaattaaacatacacttaaccataatacctagtaatttcactcctaggtattaactcaacatacatttaaatatatgtctacccaaagtcatgtaagttaatagcagctttatttattatagcccaaatgtggaaacaacccaaatttccatcattggtgaatggataattaattttggtatattcatacagtagaataccaactgaataaaacaagacaaaagatcaatgaggaaacagaggacttgaacaatacaagaccaaatggacctaaccgacatacagaacatttcatccaataacagcagaatatacactcttatcaagcatgcatggaagattctctatgataaaccacattagaccacaaaacaagtcttaataaatttaagatttaaattatgcaaagtatcatctctgaccataatggaatgaaactaaaattaattagcagaaagaaaacaggaaaatttgcaaatacatggaaagtaaacagtgtgttcttaaacaaccagtggatcatgagagaatttaggaaatacctggagataaattttttaaaaagatacaacatactaaaacttatggaatatagtaaaagcagtactaagagggaagtttatagcagtaaacagattaaaagagaagaaaaatctcaagtcaccaacctaatcttataccttaaggaattagacaaataagaatgaactaaatccaaagtcagcacaaagaaggaaataataaagactagagcagagataaactgaatagaaaacattaaaaaaaaagaaaaaaatcaaccaaaccaggagttgtttttttttaaaaagaaaatcactaaaattgataaacccttacttagattaagaaaaaaagacttaaatttctaaaattaaaaatgaaaaaggagatattataactgatgtcacagaaatgaaaagaattataaagactgctgtagtgaaaagttagatgcccacaaattggatgatctagaagaaatggataaagttttagagatataaacctaccaagactgaatcataaagaaataaaaaatctgaaaagacctataatgagtgtggagattaaagcagtaatcaaaaacctcccaacaaagaaaagcccaggaccaggtgggtcccctggagaattctaccaaacagttaataccagtccttctcaaattcttccagtgaacggaagagaaagggacactctcaaactcatttaaactcattaccctgataacaaaaccagacaaagacacaataaaggagaactacaggccaatatccctgatggatatttgacacaaaaattctaaagaaaatactagcaaaccaaattatattgcacattaaaaaatcatacatcttgaccagctaaaatttatgcctggaatgcaaggatggttcaacatataagactcagtcaatatattatgccacattaacatctcaatacagaaaagcaaaattcagtaccctatcaggatttttaaaaatactcaacaaattaggagtagaaggaaactacctcaacataataaaagctaacattatgcttaacaggaaaagacagaaggcttttcctgtgagatcctgcaataaagcaaggatgcctggtcttgccattactattcaacatagtactggaaattctagccagagtaataagacagcaaaaagaaataaaaggcattcaacttagaaaagacttaaaagatctctctttgcagataacatcttaaatgtaaaaagaatttgaacaacatgggtgaatctcaaaagcattatgctaagtaaaagaagccagacaactactggaatcaaattaatgtatgattccatttgtattaaattatattaaaggcaaaactatactgacagtaggtcagtaactgcccagagtggaggactacaaagaggcccaaggaaactttgggggataatggtttccaaagttcacataattgtactattagaattagtgcattctattgtaggtaaattatttctttcataccatcaatatttagaaaatgaaagtttatgaaaatattacttaccatagcatataagttttttaaaaatacctagaaattaacctctaatgaaacgtaagtcctctatagtgtgaaattgagggatgctaaagaagatctaaatatgctgacagaaatttcttattcatgaattaaaggcagtatggcaaagataccagttctgctcaaattgacttgtagattcaatgtaattccataaaaatttcagcctttttagcctgtttatctgattctagaatgtatatggacaggctttgaatacaaaaagcaagataggtggacttgctatactatatatcaagatttattaggaaaatagaataattataacactgataatgataccagaatggtcagtagatagaaagcctagtagtaaacacccaagcttatatagacatttccatgaaagaagtgctgtggctgatcagaagggaaattaatgacttttaataaattattttgagtagtcatttggaaaaaaaggaaattagactggtacttctcaccagctcccccatccccaccatctgttttttgtgttaaagtcctaggtgtgaaaggcaaacctgtagtgctttttaaaaagaatatagaatatctccatagctttaggaaaggatttttttcaactagacacaaaaaccattagctgtaaaggaaaagatttatacatttgactacattaaaattaagagcttctgtcatcaaaatacaatttcttaaaaaggtgaaaaaatcagaatgtgacaagatactctctgttcctctacatttatttctgcagtacaaaaaagtttacatgtgattggcacatatgtagaaaatgacatgaatttaactcaggttatactagtttctatgccattttcctcagcaagctaatgttttttatcatcaaatagctacaagtaaataaaataaaagaacacaactgaatattgcagctgaggaagaatatggcagtgtatatgatacctatacacttcaatttatcctcttttctgtttgaccatgtgttctgttttaaaaatctttattgcactatttgccctatcttcattatttagtagcctaacactttcttatacccgtttctgtcaagccaccttttcttttcattcctttcattttcttaaaagaccagtattttatttactctgttatttttaattgggaatttaacatgtcttttaaactgtattaatattttaaattaggaccattatttattttgttagtgttctagttacaaagttgcaaaggttttgagaagtcaaccatgactctattttcttcataatctctcttattatgggtgcatgatttttcagaaagtactatttcaagaaaacatatttcacagaaatcccccatttgcaatacatatgtctgacaatggatcacagtacttcatcaatactaagacagttatttcacattttaacatctctacagttgggaagcatcttagaatagatgaaatctttcaattataattgccagggttttttctttcttagagataaaataatgatgcagtttagaaggggttggttacttagatttgatgatttactataatattcagaatataaagaattataaatcaattttattttattttttattatactttaagttctggaatacatgtgcagaatgtgcaggtttgttgcataggtatgcatgtgccatggtggtttgctgcacccatcaacctatcatctagattttaagcctcacatgcattaggtatttgtcctagtgctctttcaccccttgccccccacaccccgacagaccccagtgtgtgatgttgccctccctgtgtccatgtgttctcattgttcaactcccacttatgagtgagaacatgtggtgtttggttttctgttcctgtgttagtttgctgagaatgatggtttctagcttcacccatgtccttgcaaaggacatgaactcatccctttttatggctggatagtattccatggtgtccctgtgccacattttctttatccattctatcattgatgggcacttgggttggttccaagtctttgctattgtgaatagtgctgcaataaacatacatgtgcatgtgtctttatagtagaaggatttataatcttttgagtatatacccagtaatggaattgctgggtcaaatggtatttctagttctagatccttgaggaatcgccacagtgtcttccacaatggttgaactaatttacactcccactaacagtgtaaaaacgttcctatttctccacatcctctccagcatctgtcatttcctgactttttaataatcgccattctaactgatgtgagatggtgtcttgttgtggttttgatttgcatctctgtaatgaccagtgatgatgagctttttttcatatgtttgttggccacataaatgtcttcttttgagaagtgtctgttcatatccttcgcccaatttttgatggggtagtttgtttttttcatgtaaatttgtttaagttccttgtagattctggatatcatacctttgtcagatggatagaatgcaaaaattttctcccattctataggttgcctgttcactctgatgatagtttcttttgctgtgcagaagctctttagtttaattagataccatttgtcaattttggcttttgttgctattgtttttggtgttttagtcatgaagtctttgcccatgcctacgtcctgaatggtattgcctaggttttcttctagggtttttatggttttaggtcttacgtttaagtctttaatccatcttgaattaatttttgtgtaaggtgtaaggaaggagtccagtttcagttttctgcatatggctagccagttttcacaacaccatttattaaatagggaatcctttccccatttcttgtttttgtcaggtttgttgaagattagatggttatagatatgtggtgtcatgtctgaggcctctgttccattccattgttctatgtatcggttttggtaccaataccatattgttttggttactttacccttgtagtatagtttgaagacaggtggtgtgacgcctccagctttgttccttttgcttaggattgtcttggctatatgaggtctttttgtttccatatgaaatttaaagtagttttttctagttatgtgaagaaagttaatggtagcttgatggggatagcattgaatctataaattactttgggcagtgtggccattttcacaatatcggtttttcctattcatgagcatggaatgtttttccatttgtttgtgtcctctcgtatttccttgagcagtggtttgtagttctccttgaagaggtccttcatgtcccttgtaagttggattcctaggtattttattctctttgtagcaattgtgcatgggagttcactcatgatttggctctctgtttgcctatcattggtgtataggaatgcttgtgatttttgcacattgatttttgtatcctgagactttcctgaagttgcttatcagcttaaggagtttttgggctgagaagatggggttttctaaatatacaaccatgtcatctgcaaacagagaaaaattgacttcctctcttcctatttgaataccctttatttctttctcttgcctaattgccctggccagaacttccaatactacgttgaataggagtggtgagagaggggatccttttcttgtgccagttttcaaagagaatgcttccagcttttgtccattcagtatgatattggctgtgggtttgtcataaatagctcttattattttgagatatgttccatcaatgcccagtttattgagagtttttagcatgaaggtgtattgaatattattgaaggccttttctgcatctattgagataatcatgtggtttttgtcatttgttctgtttatgtgatggattatgtttattgatttgcatatgttgaaccagcgttgcatcccaggcatgaagccaactggatcgtggtggatgagcttttctatgtgctgctggattcagtttgccagtattttattgaggtttttcgcatcgatgttcattagggatattgacctgaaactttctttttttgttgtgttctgccaggttttggtatcaggatgatgctggactcataaaatgagttagggaggagtccctctttttctattgtttggaagagtttcaaaaggaatggtaccagctcctctttgtacctctggtagaatttggctgtgaatccctctgatcctgtgctttttttggttggtaggctattaattactgcctcaatttcagaacttgttactggtctattcaggagttcgacttcttcctggtttagtcttgggaggatgtatgtgtccaggaatttatccatttcttctagattttctagtttatttgtatagaggcatttatggtattctctgaaggtagtttgtatttctgtgggatcagtggtgatatcccctttatcattttttattgcatttatttgattcttctctcttttcttcttttttattctggctagttgcctgttttgttaatcttttcaaaaaaccagctcctggattcattgattttttggagggtgtttcatgtctctatcatcttcagttctgctttgatcttggttatttcttctgttctgctagctttttttttttgagacagagtctcactctgtcacccaggctggagtgcagtggcacaatctcggctcactgcaagctccgcctcctgggttcacaccattctcctgcctcagcctcccaagtagctgggactacaggtgcccgccactacaccctgctaattttttgtatttttagtagagacagggtttcaccgttttagccaggatggtctcgatctcctgacctcgtgatctgcctgcctcagcctcccaaagtgctgggattacaggcgtgagccattgcacccagccctgttcggctagcttttgaatttgtttgctcttgcttctctagttcttttaattgtgacattaggttgtctattttagatctttccagttttccgatgtgggcattcagtgctataagcttccgtctaaacactgctttagctgtgtcccagagattctggtacattttgtctttgttctcattggtttcaaagaacatctttatttcttccttaatttcgttatttacccagtagtcattcaggagcaggtttttcagtttctaagtagttgtgcagttttgggtgagtttcttaatcctgagttccaatttgattgcactgtggtccgagagagcgtttgttatgatttccgttcttttgcatttgctgaggagtgttttatttccaattatgtggttgattttagaataagtgtgatgtgctgagaagaatgtatattctgttgatttggggtgaatagttcagtagatgtctattaggtctgcttggtccagagctgagttcaaatcctaaatatccttgttaattttctgtcttgttgatttgcctaatattgacagtggggtgttatagtctcccactattattgtgtgggaatctaagtctctttgtaggtctctaagaacttgctttatgaatctgggtgctcctgtattgggtgcatacatatttgggatagttagctcttgttgcatggatccctttaccattatgtaatgcccttctttgtctcttttgatctttgttggtttaaagtctgttttatcagagactaagattgcaacccctgcctttttttttctttccatttgcttggtaaatattcctccatccatttattttgagcctgtgtgtgtctctttgcacatgagatgggtctcctgaatacagcacaccaaaaggtcttgactcctttatccaatttgccagtctgtgtcttttaattggggtattcagcccatttacatttaaggttaatattgttatgtattaattatatcctgtcatcatgatgctagctggttattttgcacattagtcgatgcagtttcttcatagggttgttggtctttatattttggtatgtctttgcagtggctggtaccaatttttcctttccatatttaatgcttccttcaggagtaaggcaggcctgttggtgacaaaatccctcagcatttgcttgtctgtaaaggattttatttctccctcacttctgaagcttagtttggatagatttgaaattctgggttgaaaatccttttctttaagaatgttgaatattggtcgcctactctcttctggcttgaagggtttctgcagagatctgctgtgagtctgatgggcttcctttgtaggtagtctgacctttctctctggctgcccttaacattttttccttcatttcaaccttagagaatctgacgatcatgtgtcttgtgattgcttttcccaaggagtatcttagtagtgttctctatatttcctgaatttgaaagttggcctctcttgctaggttgcggaggttctcctggataatatcctgaagtgtgttttccaacttggtcccattctccctgtcactttcaggtataccagtcaatcataggtttggccttttcacatagtctcatatttcttggaagctttgtttgttccttttcattcttttttctctaattttgtctttatgctttatttcattaagttgatcttcagtctctgatatccgttcttccacttgattgatttgcttattgatacttgtatatacttcatgaagttctcgtgctgtgtttttcagctccatcaggtcatttatgtttttctctaaactggttattctagttagcagttcctgtaaccttttatcaatgctcttagcttccttgcattgggttagaagatggtcctttagctcagaggagtttgttattacccacctcctgaagcctacttctgtcaattcatcaaactcattctctgtccagttttgtgcccttgtcagagaggagttgtgattatttggaggagaagaagcattctggtttttggaattttcagcatttttgtactggtttttcctcatctttgtggatttatctacctttgatctttgatgctgatggcctttggatggggtttttgggtgagcgtccttttggttaatgttcatgttattgctttctgtttgttagtttcccttctaatagtcaggcccctcttctgcaggtctgctggagtttgctagaggtccactccagaccctgtttgcctggtatcaccagcagaggctgcagaacagcaaagattgctgcctgctccttcctctggaaacttcctcccagaggggcacccacctgatgccagccagagctctcctgtatgaggtgtctgttgactcctactgggaggtgtctcccggtcagaaggcatgggggtcagggacccacttgaggaggcagtctgtcccttagcagagcttgagcagtgtgctgggagatctgctgctctcttcagagtcggcaggcaggaacatttaagttactgaagctgcacccacagctgccccttcccccaggtgctctgtcccagggagatgagagttttatctataagcccctgactggggctgctgcctttctttcagagatgccctgcccagtgaggaggaatctagagaggcagtctggccacagccgtttttctgcgctgcagtgagttccacacagtccgaacttcctggcggcttccttaacactgtgaggggaaaaccacctactcaagtctctgccatggtggatgcccctccccccaccaagctcgatcatcccaggtggacttcagactgctgtgctggcactgagaatttcaagccagtggttcttagcttgctgggctctgtgggagtgggacccactgaccaagaccacttggctccctggcttcagccccctttgcagggaagtgaacagttctgtctcactggagtacaaaaaaaaactcctgcagctagctcaatgtctgcccaaacagccgcctcgtttcgtgcttgaaacccagggccctggtggtgtaggcacacgagggaatttcctggtctgcaggttgcaaaagctgtgggaaaagcatagtatttgggccaggtagcacagtccctcatggcttcccttggttaggggagggagttccctggctccttgtgcttcctggatgaggcgctgccccaccctgcttctgctcaccctccgcgagctgcacccactgtctaaccagtcccaacgagattatctgggtacctcagttggaaatggagaaaccacccaccttctgtgttggtgttgctgggagctgcagaccagagcttttcctatttgggcatcttgccagctcccacaaatcaattttaaagacacaaacccaacagagaaatggggaaagacttgaataaccacttcacaacagaggaaatctatatggcttctaaatgtattaaaaagaatgtttaatctcataaagcaattgctttatgaggttgaagtgaagggtaaaatcttgagtagccctcctatttttcggatgtcttgttcattgttgaggttgtggatgatatatccggagcatatgaatagtatggctttaaagaaagtgtgggattaaataaacagtgaagtgactttacacacccaggatattggaaaaatcttataagcctcatgacaagtattggtgtggacagaagagaatgcatgttatgtgattccattcatacgaggttgcaaaagtggcaaaactaagctatgttgcttaaaaatgcattatttagttggtacaatcattaaaaaggaaaggaaatcatcacagatgtcaagatggtagtcacttttgaggatggagggagggagaggtttatcatcagagacacacaagaaggtttttgaggtcctggtaatgttctgctttttgcttgggttgatttgcttgtaactaaacagaaagggtaaatgatcagttatgtcaaatgttattcataggtcagttaagatgagggtaagacttggccattgagttcagcaaagtggagactattgttgaaacatagcacattgtctcagtgaatggttggggaaaagatcttatttgaataggctcaggagacagtgagaggagaattggagactgtgtatggctccaaagaactcttcggagcaatttttatgtataaaggagaaatgtggtgagaagtgggggtgaggggggatgtagaaagctttatataaaatatacagtattaggagaatataaagataaattttatggaatgcgaaaagtaatggggtgaaggaaggaagataactttatgtgtattgggttgtatggttttgtggggggagtgaaaatttataatactttgtaaagagaattaacattaaaactattttctagtcttagaaatatatggtagaattacacataccattcatatctgtccatgaaaagaatcatggacaacatcctgctcaacaccaccttgcagaaagagaaagccaaaagagattaagtagttgcctaaattgtgccgttaataataatcacagaccaaaacagagttcctcctgccctttcgatcagtgctgtttttatagtattatctataatatggcttgcttttaaattgttttttagtcattatgttttatagtggagtttatttggatatctcaattagcctttgctgtataacagactaccctaaaacttagtggcttaaaatagtgatgtttatttctcatgatttcatgagttgggctcagtcgggaccattcatgtggctataatcattgacagctcaactggagctggaggggctaagatggcctcattcatgtgtctggggccttgctgctttttgttggcttgggctctctttatcactcagtagtctagcctggacttccttgcatggtagcaggagcattccaagagggtgaatatggaagtctagatccctaaacttggacaacatcacagcctttacattaaattaatcaaagcatatcatcaatccagtccaaattcaagggatgaggcaacaggccccacctcttaggaggtgcagaatatcgtcatcatattttttccatctgtcatagataattacaaattataattttaatccttgaatttccttttttttttaagagacaggatctcactctgtcgtcaaggctggagtgcagtggtgctgcaatgataacccactgcatcactgcatccttcaactcctggtctcaaattatcttcccacctcagcctcacgagtggctaggactactggtgtgcatcactatacctggctaattttaaaaatttttttatagagacgaggtcttactatgttgcccaggcttgagttaatgtctaatgttaacttttatttaatatggagctaagaagctgttgattcagagaatctaacaatgtagttttggtcaataatgagaaatataaaaatttgaaaataaaaaacgtattaaaaattaaaggaaaaaagctgttttccagattttatatcctctatgatgtaaaacaggtaaagaaatgcttatttttagaaaaaaaaattgggttaaaaaatgggggagaaaattcaatatagtctttgttgcacagaatgttgacataatcattattttctcagattattaccattaatttgttatcataatctttgtttttttttgtgcatgttacagaatataatagaatgtaatgtgactaaaaacagtaggagcaattaagagtttcccatgaattaacttacagtaataataagagcatattgccaggcactgtcctaaatgcatttgtttacaatttcacttaatttatttgacagctatgtatattcagcacctactgtgatctttgcactgtgtcaagacttggggctattactctgaatcaaatcgacatggtttctgcatgttgccataccctagatagaaatcagggaaggttctctaaaggaactttctaagccaggacctgaaggatgagtagaagttagctgaggtgagagtgggaaagggagtaggaagtcctctggggacatgacaacgaccttgaaagtatgtgagtgaaaggaacattaaaataattgaaaaatatatgtagtatactaaagcctaatgtgaaaggaatgaggcaagaaagaatttggggaggttgccaggggccagatcacaaagggctttgtaaaatgtgttgttatagaatctggattttatgccaaggatcatgggaagccattgataggtttagagagagattttgtttgtttcctcagactgtgttttagaaaagtcactgactgcagtgactaggaggagtgtagctgggaagaagtaaaggttgacctaggggtaccaacaataaaggtcctagataatgatatgaattcagtgattatgggaatgaaaagaagtatttagaaatacttatgaggtagatttggtgactggatgtggagtagagggaagagcccaagacgactgactctcagatttcctacctggagtgctattactgaataggggcctaagtggaggaacaggtttgagaaggaaagtgttcttgtcctagacttgcaaccaattcccagtgaaaatcctgtatctctttgtattatctagtatttgaaatgacattgtgtaaaagtgactcttgtttagtaaaattcagtcaaatgtagcaatgctgccataacctgaatttacaccttgaagctgaaagattgtactttagcatttagtgatctgttactgtagttaattttatgaaacaatttacttactgcttaatttttaaaaattacttgaagagaataatggctaagaagccatatgtgaatacctatcttaagccttttattcacatataaagtaactttataaccagtgtttgtccaacttttaaaaataaagttcattaaaataacttataaaaaatattattttttgtctttcatgactctagtaagtagaatgtttacatttatgctagagatgaaaaaattaagtaggataactactttaaaataagtctgtctttcaccaggtgtgcacatgtatcaaaacatgttgtatgctataaatatatacaattttatctgtgaattttaccttaataaagttggggcaggggaatgaaacatctcttatgtgttctctacaaactgaatattcttttactttgaatattttgtaagtttaaaagtactttacaacctacttttttttttcttttttcttaggcactacaagggcccccagggatggagaagtaccaggagtggattataatttcatttccgttgaacagttcaaagcactggaagagagtggagcattgttagaaagtgggacatatgatggtatgtccccaaataacatcactaccacccaaaaaactatctgaacgactggaattatttcagagggaatttgaccagtaaagtaccactttttgaaaaactttttttcctctctgtttttgagaaaattttcttttgatggggagatttgtaatttattaattaaaatgggattaaataataagcaaaaaaaatccatcatattttaaagttgattgtgaacagtatactaaaaatcagccagactggccagtttatatatttcatagtaattcacattcatcatgtgaactcagtgagtatttgttgattgcattttatttgtggttggaattcaaaatctgtactttaaaaaacttacatgtaccttgactatcctggaaaaaagagaatataaaatttggggagaaaacaacaaaaacagaataattggttttcttttcatttctgtttcctctacccacttgattccattgatatttgatatttgagatcaatttccatttttaaatgactctgttagatctatttttccccttatgtaacatacccttccctggcaagcttatccacttccatagcaccctacgctatggtccattattgctttttcatactattataattgcctgtttataagctctgtgatagtaatggtcatgtctttcttacttgatattatcttcagtgcctaaagatagtgttcaataaatatctaacctggaattcagcgtatctaaatatgcatttgtgttctatccaaaagagaaattcttcatcatttctctctttagcagcaccatgatctcagaacagtgaaatcattatttactttctcctttttctcacatttcacatccatttgccaaatctcatcatttcttcttttgtagctgcattcacaatacccttctttcactttcaccacctcattgtaggcccactagaagagctcatgtgtggactattgctgttgatctcatttgttcccatttcttccaccctgcccattgctaccatgctagtcttcttcaagagcagctttatcatgtctctctcctattcagaactttcaatgatttcctttcatctgctaagtttaacctaactaccttttctgggcttagcgcccatgactcattcatttgttcattcgttttatcctgttttattcattaaacaaccatttattaagtacctactatgtgccaagtactaaaagagaatctcggaatactgtaatgaacaagattaaagtgcttttgaagtttttttttgtttgtttttgtttttttttaagaagccctctccccttaaatgatgaagatgctctacattttcttccactaaatataagagcttggtatggacgaagtggcatattacttattattaattgctgtgtgctcaattcaaagaaaatgcaaattaaaatagttgtacattatttcacatccatagattggcaacaattttacagtctgataattgcaagaaatggaaactcccatacactgctggcaagactataaaatggtataatccttctggagagcatcgtggcagtagctggtaaatttgaagatatacataactctgacctagcagtgcccctctctagacatctactcaggaaaaactgttgcccatatgcatatgtagacacatatgggaatatttgttatagtgtgaaacagtgacagaatggaaacaactctcctttagtagaatgaataacatacattttaatttgttcataaaaatggactgctatacagcagttcaatgtactggatttataggtatcaacattaataggtcttaagaggcataaaaagtataaaattatataaaggtataaaattgtataaaaagaaagttacaaaaggatatgtacattatactatttatgaaaaaatatgtgaaatattgtgaaaatactctgtgaagcttttatgaaaacaatagtatttacatgttatagatgcatatatacatatcctagatgtatattcaggaggaaagacacatatcaacttcaggacagctcagggagggagtggctatagggacaggaagttagagctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatattgaatagttggcatttctgcaaaaatgaaaaagccttcagaaaataaaaaaaacttcaaaacagctctaaaacaatgaaaatctttgtcagtaactatagttagggttcacaaaccttggaattgtatactgtatctgaaaacttggtatttaccaacatctcaagaaaaaatagatctaatttattttatttatttatttatttttattattattatactttaagttctagggtacatgtgcacaacatgcaggtttgttacatatgtatacatgtgccatgttggtgtgctgcacccattaactcatcatttacattaggtatatctcctaatgctatccctccccccagatctaatttatttataaacaatgctaatttttttttaatctgagccccataattatctttttaaacaaggaaactgcccaaaattattatgaagtcctaaaatcttttcagtgattatggatggcagttatcatatcctgcatttttatattttccccttagaaaaaggttaaattttctcgagttagataataattaccaagaattctcagtaagatgtgtttctagtagtactactaccttacttagaaaaagtggactttttatttctgtcatggtatatccagtttccttgatactgtgattaatgggcataattcaggaaaaatagagaccctcgaacctcctaatccccagccaaatctctgtttggtgtatttctgtgccggctgccccagagaagcgtgactggctttttcattggttctttgctttacttctgagctagaaagtttgcagaaagtttagtctgttttcatacaaatctttgcatccatctgtatgactggagtaactccatttcaaatatggatttggaaacaagggagtaggtgagtagggagagacaggatgtcattgaaaagttttttagtttcattttattgttttgtcttcattattttaatgacaattactgctgaaagtcaaacttccaaagaattcatgttaaatgttttccccctcaaaacatgcacaatttaaggtaaactatgtaatgtctagatttgtctcagcattatggggaagaacctatgctattttctatctaggaaaaaacaatcaattatctacctcattaatttaccttaggtgaatgagcatcttaattacttccttaggagctaaggaatttgattagaaaatatgattttagaaaaatcatgagtattttactctctaatcatatatatatttctctaacgttagcataatgattaatagaatgtcaaaagtagtaggaaccacaaactgttaatgtggctagacctgttgagtgctttcccatattatttggcggcctagtgggaactgcatgacaaattgagaagatactcaattgttttcattcttttctggaacatttatttttactgcaaaaattacagattctcaagagaaagttaaagtatttcttgctttcctgagagtaagccaatactgaattatcctgctaatgtctctgtttgttcaataaattgtcagataaaataatagaatgctcagaaaaacttttaaaaattacccttacataaaaagcctacatttttatatgatctggttagttcttagcttaacctttacctacatacttcctcattttaccaaaatagttcattatgttacacattagaacaaaattatttcagttagttttatcctcatttacccccaccttttatgccaattagtcttacatgacagcatcaatgcatttaaattcacaaagtatgtcctaattcagaacccatgtaaggcaatccctgtaggaatgaataatctacttacatacagtcaacttcctggccttaaacaaatagtattaagatattagataatatatgtgaagagcacttgagaaattagttctttcccctatttctgctctctcttctcgtaagatgagtgctttgagcgctttggcctccttttggccaatggtagatatttccttttttttttttttttttttttgaggcagagtctctgtcacccaggctggagtgtagtggcgcaatctcagctcattggaacctctgcctcctagattcaagtgattttcctgcctcagtctcccgagtaactgggattcacaggcatgtgctaccatacctggctaatttttgtgtttttagtagagatgggttttgccgtgttggccaagctgatctgaaactcctgacctcaaatgattcacccatctcgacctcccaaagtgctgggattacaagtgtgagccaccatgcccacccctatggtagatatttcaaaacttctttgtgaaaaacagggcagagacatacactaggtcaaattgctctgactctcactgcaacattagtaatttcagctgctattttattcacttcaggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcaggtttgtaaatagatgaacaacttctaactgatcttctagattgattttactattacgttgaattaaaagcactaaaattttttacaaagcatatggagagcaagtgatgggattttaatttttttgtaaaggttgtatgtggagcaaagtgtatttctgtagaccatcctataagctaaagtgagttgtcccaatttggataaatcaatgataaactatcattagtaataaaatatatgccattaccctgctgtttaaaatatttgagatttgcctctgatgttgcaatgtgggagtcttgttggcctatgtcttactttacaggatgtaaacaatatatggatgttttagaatgtagacttcagcctaaacaaagtaaatagggcttgaaagtatgctgataaaaattatctaaaaggttggtttataatattttgaatttaaattttggattcactcaaagaaaaatttcaaatatgagacccttcattaaatgtaaaaccaacagaaattcagtggtgaagaatctgctccttttgagtagccctaattaatgtggtgattgcttagagggttattagacttataactgagagtataactaggaaaccatagaatcacagctgagcttattcaatggtattcattgcaaaaattccattcagaacactagaatgtaaacttcatagggctgaagttttcctttttttatgtactgttctatcccttccatcaaaaacatgcctggcatgtaataggaactaaaatcctcaaatttgcagaacacatttccttatcattttcccaaagcaccctaatctttttcatcaattattaaaatgtgatatgtatatttattgagttaatacattcattgtttatgtcccactccagagtgtgagttctgttttatagtcctatctttcacataatacgtttaatgttaaatggattaccccaatgtatttaaatgtaaatactaaaaacaggttttaaaaggtttaggtgaattcacatctaatttttaggagttcctaagggaactcatcacaccgttgagccttttaatgttgatatcagctttgctatcccacaaaattaagtctgttaacatttaaaaatgctaaacagtaggattggagaccatgaatctttcccaatatgggaatttatatgttcttgatttaagggaaaagaaaatgttctttttttacttcctaatacagagcctttaattgatcactgcagttcttttagcggtaaacttgtttgtaatctctatagttgatgcttcatgtaagtcacttgttaaactgatgttatatactctttgatgttaatatttaaagggaatatatccaagggtgtgtgggaggcagttcgtatactacctcttatgtatagataccataggacacttacattgaattacatatttctttgtcatagaaaatatacaggacatttaagtgaaaaaatacaaagcacccgcctacaaacagaattcaccttctgaataagtatgaactgtagttgttagttaactaatcaaagttggggaaatatgctttgtgtgttgcttttgttgttttttgtttatttgtttgtttgtttgttttgagacagagtctccctttgttgctcaagcaggagtgcagtggtgcgatcttggctcactgcaatctgtctcctaggctcacacaattctcatgtctcagcctcctaagtagctaggattacaggcatgtgccaccctgcccagataatttttgtatttttagtagagacagggtttcaccatgttggccaagctggtctcgaactcctggcctctggtgatccgcctgccttgacctcccagagtgctgggattacaggcgtgagccaccgtgcccagcctgtgtatcgctttggaatccctgccttgaaaaatcagaaaattgttcgggagtagaaatgaggagaggataggtagaggtttatttgtgcacaccagtatgtttattattttatatcttgctgaagaaataacccaaaagaaagttaaaatggtcatgtacaataacatatgttacgtaataattattttttttctaagaaatggttttatataaagaacatcttcccaagtcattggctattaagcaaactcctttattcaattgcttggaactatattaagaaaagtgttatagatcatatacttgcttttacttttctccaacatggttatttcccaagaatgtaactcctttccagattgatttttccattaggtaccttttaatttctatcattttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaagaatgtatataataaagcatcttgtaggtcattggaagaattttgatttttattctgaaatgagaaacgattatggggttttgattcaaagagtaacatggtacaacagtttttaacaggcttattgtgactactgtattgagaataggcaaaaggaggacatgggcaaaataccctaactgggataccagttaggaggttattgaatgtgcaaggaagaaagtgatcagatgctgctgataactcaagtaggatggaactgagaaatgatcattggatttagcaatgtagaggttattgatgaccttgataagaatagtttaatgataggaattcaaaagccttgttggagtgaggtccagagagaactggaagagtggaagtggaggtagcaaatataaactctttcaaggtggtttggtgtaaagaggagagaaataggttggctgccaaggggtaaagagaattattttctttttactgaactgggaacatgtttttatgtggttggatatgatctaatagatagagaagattggtgatgcaggaaggagagtgaaagaattgctgtaggcaagagaagatgggatataatttataattggagggttagccctagctaggagtacaaacagttcttccatagtaacagatggtggagtcaatgggcacagtttctgtgtagatgtgatggtgggagtttgtggaagttttcttctgcttgcttctattttgttagtgaaataagacacaaggtcatcaaatgagatgagggataagggaaaagtagtggatggtttaaggagaaagaaggtatgaaataattatcttggagaatgtcagagtgaatcaactaaagaaatgtgctatgatcatcatgcatcattaaatgcccacataaggttagtgatcatgaatttaaagtaaacttgtcaatattgcctgtattcagctgtgtatggtgacatggagtaggtggagagtaggatttaagcagagttctgatttagccaggcagtattatgaagtaaggttagggcaaaggaatcaggaatatttacaagggaataattatagtggttcatcatggaatttaagttgggttagcagggcaatggggaaatgggtagaggataaagaatagtgaaaggtagtaaatagtagggcatggttagataaagaatggttggagttgaaatactatagagaaggatatctaaggatatataagatctctgtcagattctctgaatctgagccattgcctgcaatttgaagttgttatagtgatattacatagcatcgtttaagttttagaaacaagttttaagtacacgaattgtgaactccctagacagtacccaaattttagtattcttacctacattatgggctttgggactctaaaaggattttaatattactaaacagaattatatttaacaacaggaactctattgagtgtaatttttaaaaattactattatttaaaggccagtgttaaatgtgtacaaggcagcttagtatagcaggtgagagcatggaccacttagattcagttcatggctttgctgtttattggcagtgtaattttgactaagttaacttaacctctctgtgccttagttttctcagtctataaaacaaggagattaataatagatactcacagggttgctgtgatgattatgagttaacatacagaaagcacttaaaatagagcctgacacataaaaggactacattagtgctgctgtagctgctgtggcttattaggatttatactgaattaattctattgttgttttttgcttctttccaagactagcatcagaggtgctatacagagttaattgtcaattactaggggaaaagagttgaatatgttggttattttaaaatttatagcagaatgtggacataatagacaagaaatttgccatatttatgtatttggaatttttttagaaaggaaaggtgctgtttgaagaagaatataactttacccacttttcacacctttctgttttgaacaatggcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgagtaagcaaatgtctctatctcttctaatgtgccctaacatgttgaggattgtctaagatttttttaaacctcattttagacacatacctttttcagaagactcattttttttctttctttaaaaatatttttcataaaactgacagttgatttttaatcagatttaatctgacacttcatttttatttgacttggataaaggaatagtgtatttgacttctggttttataagagcaggaggatcaaaaacagttcacgaatggtgaaaaatgtaaagaataaagggtattttgcttggctttttaaaaagcttttaggtagattgtccagcttaatgagatttcaagaattgtcatcatgagtaggagcatattattatccgaattaaatattttcagtcctggagtttgagtttgatgtgttcaggcaatatagttgaatgatgtaggaagaaaatatcactgatcatcagagtaattggtacaaatttaagttcacaaaaaacattatttttatggaaaagcactattaatataatatttatagagatactgattaccatatatattagatcaacctaaaattgtatgttgtttgtactagagaataatattatgcaaataattattggaagttttatcatgaagaatttttatattctcacgtagctgtaattctcatcgtaaagtaatttgcccaaaggtagaatattaatgtagtaaagttacagaatataacaattaaataacggttaaaatatttggatctaggcactacactcaaagaacatatactcagaaatgaatttggagtgggagtcttgaatctgtttcctcagatggtcccaattccgtacccttccaaaagagtgagcgtcttgctataccaaataggattctagtttttaaaagacacggatctttggatgtgtagcgttctttttactatagattgcacattattgatgaggttatacatttatataaacattcatcaccacaattatacaaagcaggtacaaccaggtggtatattcttctttattgacaactttaagggatttgttaagggaaatttagacttttgactttcatgctgactttagaactaagccccaaaataaggtgtagagtcattagaagtagctaaaatatctttaaaaacagattatgagacatttaatctgacagtacttcaccctgcaaacagggctaagttagtaaattaaagagggagaatttataaaaagaaatatttttatagtttaatatatgtaaatggatgaaagatctaaatgtaagacctgaaactataaaaaggaagaaaacatagggaaaaagctttacaacattggatttgccaagggctttttagatataacaccaaaagcacaggcaacaaaagccaaagtagacaaaaatggactacatcaaacttaaaaatttctgcatagcaaagcaaacaatcaacagagtgaaaaagcaatatatagaataggagaaaatatttataaaccatatatattataaagggttaatatgtagaatatagttaaatatttgctgctagataaagctgtttggtttggtataaccagtatggttgatctgtattactgctgctgttgaaaaatgcaactgtaagaaaataatgttcatataggtctatagactttagttcttatgttttgggaatatcccctatggatatttcttttcattggaaaattttgggtaaaattttagcaaattgcctacatctgctgatttagcaataaaattttggatcatgggaacctaagttaagcttttctcaagtggcagtttttagttgggtttagcaaggtattttcgtgttgttgttgttcttattgttgtttcctaacaatctatgtggctcctaggcccctgagttctcatcctttgcattttctaaaatttttttttaagcaaaaaacttttaagtttggggagattatttctctaatagcatgagtaatatagactttctagagataatctcacttttttctacagaaataagctattattcagcatattaaaaactgttttggccaggcacggtggctcacgcctgtaatcccagcactttgggaggccgaggcaggcggattatgaggtcaggagatcgagaccatcctggctaacatggtgaaactctgtctctactaaaaatgcaaaaacttagctgggcacggtggcgggcgcctgtagtcccagctactcgggaggctgaggcaggaaaatggtgtgaacctgagaggtggagcttgcagtgagccgagatcgggccactgcactccagcctctgtgacagagtgagactctgtctcaaaaacaaacaaacaaacaaaaaagtgtttctatcacattctaccagctagtattatacctggcagtggctgcagagctctgcaagtagctcagcggttacaaaagatatagaagatgtgagtaattccctgaaaccttattggcttcatttcctaagagtggtcaaggtacagattagtgagtttatttcatgttaaacacactcaggaaatataacttgtttacattcattgttactaattaataacagttaattacttcagttaagtatgacatggtattccaataataactttaggcaagagaatcacttgagccgaggagttcaagaccagtctaggcaacatagccaggcctctctctgcaaaaaaaattttttcagttgttaggcatggtggcacacgcctgtagtcacagccacttgggagcctgaagcaggaggatcacttgagcctaggaagtcaaggctgccgtgagctgtgatcatgccactgcactccaacctgtgcaacagagcaagactctgtctcaaaataataataataataataacaataactttaatttacattttattcccttcctatgtattttcttccatgactttttctttctttaatatccttgtatgtcagatatttaaactaacactgtttgtccactaagcaatgagatagtttcatttcggcgttagtatctgctgcatggtgacctggtctgaaactaactgactatgacatataatgaaattaaacagatactgctctctaaagtcatctttggcctatatcataaaatgaagcaggggcaggatatttttattcctcccttttttcctgtgtggatcatgctgatgaaaacttagttttgtagagcagagtttaactatacctgttgtttttacttgcatgtggcagaaacagccactttaaaactctttgttttattttattctattttattttaaagagtccctgagggcaggagctctatctgatgtttatttatctttatattccagcttcccacacagtacctacgtatcacaggcacacaagaaatatagtactttttgaagggaagaagaaaggagttcagccagtgagcaaacaaggttttcagtgcagtattgttggctagataatgcacagtatgtggctatgcgcccaccttttgaaacatttttaactgcttaaatagtgtctgttattccatacttggcattttaggccttctttaaagtctcttgattctcaagttagtgcctctagcattaccattcctttatggaaattttgaagtagactgagaacaatagggttaatgaatgaatctgaggaatacaaatggagcctgttggagattaatgttcaaacatcatgtcttttagtcacttttaatctttacttttgaaataattttctcctcctttattttactgtttctaattaaaatctttattctacagccacaataccaagacaaccacctggttggatcctcgtctttgtaagaaagccaaagcccctgaagactgtgaagatggaggtagagattcagaaacttactctatcatacttattctcttaatcctttcttgctcttcttgctcagataatgggtttttcaaaaccctaaacaaaccataatgtacacaagcaaaaaagcagtgggtggatatcataatcaactgattgtggtaattatgtcattacatctaactttatgagagatttcatttctttttcaggattacataactctctataaaaaataacaacaacactaaaatacatttgcccttttttgacatctgtcctgaagacagacttttaaaattctaaataaatatttaaaaattaggcacatcctcaaccataagctaggtctatcatgtcttatgaagtttttaaagtatatttaatttagtatacattacagtagatatgcaagtatctatagctattcttagccatttacagcagcagtagaaattcaaggaaagtctttaatataggcccccacacatatacacacttactttttactgcttaaaggaaaaattatttctctaagaatcatcagataatagcacttatctgtcctatatattataggttatatttaacagtgtagttttgagctgggtgtggtggcacaaacctgtagtcctaaagctatatggggagctgaaatgggaggattgcttgagctcaagagtttgagatcacagtgagctgtggtcatgctactgcactccagcctgggcaacagagagagaccctgtctctaaaaactaataaataaacaaattgttaaaaagagtagagttttgtaaataagtatagaatttattccatccaaaattgtttgctatgtctttaccttaggagatgaataaaatttgcatttttgtattactaatcagaaactatgtattaattggttttaaaaaataagtggcgtaaaatgaggttcacagtagtcctccttgtattgaagtccaatctataaaaagaaattaaacagaatttccacatatattgttcagcatgattataatataatattaagagttttctaggaagaagcaatcagaaaatggaattgtttaaaattccctctacaatggcatcaaaaaagttagatagcttgaaacaaatcttctgaacaatgtgcaagttctcaacactaaaaactacaaaacataattgaaagacataggaagacttaaaataattgacaagaggctgggcatgatggctcatgcctgtaatcacagccaaggtggatggatcacttgaacccaggagttcaagaacagcctgggcaacagggtgaaaccctgtctctactaaaagtacaaaaactcactgggtgtggtagcatgcgcctgtagacccagctactcaggaggctgaggtgagaagatcgcttgagtccaggaggttgaggctgcggtgaaccatgatcacgccactgcactccagcctgggtgacagagtgagaccctgtctcaaaatactaatactaatactaatactaataataattgacaagatatattctgttcattagccaaagaaccttaaaaaaaaaaagacaaagttggaagacatagggtaccagatctgaagacttattttagagctacagtgataaagacagtttggtattggcataaggatagataaatagatcagtggaacaaaatagagagtctagaaatcaatacacatgtatgtagtcactttattttcaaccaaagtgccaactgatatggaaaaatgaacctcaattatgcctcacttcatacaaacagttaatttcagatgaatcaaagacctaagcataaaagctagaaccacaaagcttttggaagaaaatataggagagtgtcttcatgagtcagaattggcaaagatttcttaaacaggccacaaaaaatatgaaccatagaagaaaaagttaatattttgcatgtaatagaaattttaaaattctcttcatcagaagacaccattgaaaaatgaatagacaaagtcacagactttgcaatatatatttgccaaaggaattaaattcagaatctataagaactgtttacaactcaataatattgccaaattttaaaatgggcaaaatatgttaataaacatttcaccaaagaaaatatacaaacagcccataaaaacatgaaaagatatttaaaattattaatcattaggtgttttgcaaattaaaaccactgtgatctactactttacacccactagaatgagtataacaaaaaaaaaaacagatggtaactaatcttggggaggatagggagaaacagtaacccttgtacattgctgtgccattggaaaatggtatagccactttggagaacagtttggcagtttcttaaaaggttaaatataaatttaccatatgacctagtaaattttctcctaggtatctacccaagaggaatgaaaacaaaagtcctcataaagacttgcatgcaaatattcatagcagcactattcataatagccaaaaagtggaaaccacccaactgtccattaaccaatgagcagataaatcaaatgtgctataacctacaatggaatactattgagcaataaaaaggaacaaaatactatacatgctatatgtatgaatctcaaaaacatgctaagtgaaagaaattagacataataggccagatattgtatggttctatttgtatgaaatgtccagaataggcaaatctgtggaaacagaaaataggttactggttgccttgggctaaggataagaatagagattaactgttaacagcatgaggaatcttcttggagttatgaagacgttttaaaactggattgtggtgatggttgtacaattcagtaaattattaaaaattattgaactgtatacttaaaacagatgaattgtatatatgtaaattatacctcaataaagttgtttttaaaatggccaaaggacttatgcacttcacaaaagaagataaaagaagagtcaagaagaacatgaagaggtgcttatcattagttatcactacaatgagataccatcaacacccactacaagggctagagataccatctacatcctttagaaggactaaagtacactgacgctcagcagaaaccttacatgccagaagggattggagttctatctttaaccaccttaaacagaataagtgtcagccaagaattttgtatccagcaatactaagtttcataaatgaagaagaaataaagtatttttcagacaagtaaatgttgaaggaatttgacattaccagatcagccctacaagatatggtaaaaggagttctaaatcttcaaacaaaaagttgatatgcaccagaatagaacctcttgaaagcatgcaacttacaggactgccaggcacggtggctcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcacagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagttaaaaaaaaagacaaagaaggtcattatacaatgataaaatgatcaacaagaagatattgcaatactaaatatatatacccctaactctagagcccccagattcatgaaacaattactattagacctaagaaaggagatatcaacacaataatagtaggggacttcaacactccactgacagcactagatagatcattggagcagaaaatcagcaaacactggacttaaactacactctagaacaaataaacctgacagatatttacagaacaattctaaccaagaactgcagaatatacattcttctcatcagcacatggaaccttctgcaaagtagaccatatgataggccacaaaacaagtctcaataaatttttaaaactcaaaatcttttgtgggcatttagtgctataaatttccctctgcacactgctttgaatgtgtcccagagattctggtatgttgtctttgttctcgttggtttcaaagaacatctttatttctgccttcatttcgttatgtacccatgcccacaagagaaagcaggaaagagccaaaattgacatcctaacatcacaattgaaagaactagaaaagcaagagcaaacacattcaaaagctagcagaaggcaagaaataactaaattcagagcagaactgaaggaaatagagacacaaaaaacccttcaaaaaattaatgaatccaggagctggttttttgaaaggatcaacaaaattgatcgaccactagcaagactaataaagaagaaaagagagaagaatcaaatagatgcaataaaaaatgataaaaggggatatcaccaccgatcccacagaaataaaaactactatcagagaatactacgaacacctctacgcaaataaactagaaaatctagaagaaatggataaattcctcgacacatacaccctcccaagactaaaccaggaagaagttgaatctctgagtagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccgtgatcaagtgggcttcatccctgggatgcaaggctggttcaatatacgcaaatcaatgaatgtaatccagcatataaacagaaccaaagacaaaaaccacatggttatctcaatagatgcagaaaaggcctttgaaaaaattcaacagcccttcatgctaaaaactctcaataaattaggtattgatgggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaacggtattcaattaggaaaagaggaagtcaaattgtccctgtttgcagatgacatgatagtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatacaagaaatggaagaacattccatgctcatgggtaggaagaatcaatatcgtgaaaatggccgtattgcccaaggtaatttatagattcaatgccatccccatcaagctaccaatgactttcttcacagaattggaaaaaactactttaaagttcatatggaaccaaaaaagagtccgcattgccaagtcaatcctaagccaaaagaacaaagctggaggcatcacactacctgacttcaacctactacaaggctacagtaaccaaaacagcatggtactggtaccaaaacagagatatagatcaatgggacagaacagagccctcagaaatagcgccgcctatctacaactatctgatctttgacaaacctgagaaaaacaagcaatggggaaaggattccctatgtaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatgagcaataaaagccaaaattgacaaatgggatctaattaaactaaagagcttctgcacagcaaaagaaactaccatcagagtgaacaggcagcctacaaaacaggagaaaatttttgcaatctactcatctgacaaatggctaatatccacaatctacaatgaactccaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaccactgttacaccgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacaagtatgtttattgtggcactattcacaatagcaaagacttggaaccaacccaaatgtccaacaacgatagactggattaagaaaatgtggcacatatacaccgtggaatactatgcagccataaaaaatgatgagttcatgtcctttgtagggacatggatgaaattggaaatcatcattctcagtaaactatcgcaagaacaaaaaaccaaacaccgtatattctcactcataggttggaactgaacaatgagaacacatggacacaggaaggggaacatcacactctggggactgctgtggggtggggggagtgggaagggatagcattaggagatatacctaatgctaaatgacgagttaatgggtgcagcacaccagcatgtcacatgtatacatatgtaactaacctgcacattgtgcacatgtaccctaaaacttaaagtataataataataaaattataaaaaaaactcaaaatcatatgaggtatcttctcagaccacagtggaataaaactagaaatcaactcctaaaggaaccctaaaaactatacaaatgcatggaaattaaacagtctgctcctaagtgatttttgggttaagaacaaaatcaagatggaagtgttaaaattatttgaaatgaatgataatagtgacataagttatcaaaacctgagatacagcaaagcagtgctgagaagaaagtttatagcactaaattgctacatcaaaaagtctgaaagatcacaaattgacaacgtaatgtcacacctcaaggaactagagaaacaagaacaaacccaaagttagtggaataaaagaaataacagaagatcggagcagaattaaatgaaattaaaacaaacaaaaacagtaggccagatactgtggctcatgcctataagcccagcactttaggcggccaaggcaggcagattgcttggtaatttgagaccagcctaagcaacatggtgaaaccctatttctacaaaaaatacacaaattaaccaggtatggtggtgcccacctgtggtcccagctgctccagaggctgaggtgggaggattacttgagcctggaggaggcagaggttgcagttagacgagactgtcccactgcactccagtctgcgaaacagaacgagattgtctcaaaaaataaaaaaaatcaaagtgtgtgtatgtgtatgtatacacatatatatatatgtgtatacatacacagaagatcaaagagacaaaaagctggttatttgaaaaagatatacaaaatttatagaccattagctagattaaccaagaagagaaaaaattcaaataagcccaattcgaaatgaaaatgaaaatgaaatggaaatgaaaatgaaaatggagacattacaacaaacaccacggaaatacaaaagataatttgaggctactatgaataagtgaaattgaaactgtgcacacaaagtagaaaatctagaggactggataaattcatggaaacatacaaccctcctagcttaaatcaggaataaatagaaatcctgaaccaataactagcagtgagattgaatcagtaatttaaaaattgccaacaacaacaacaacaacaacaacaaaaagcctgaggccaaatggatttacagccaaattctaccagacattcaaagaataattggtatcaatcctactgaaactattccaaaagattgagaaagagggaatcttctctaactctttctatgaagccagtatcaccctgataccaaaaccgggaaaggacctaacaaaaaaataaaactatagaccagtatccctgatgaaaatagaaagaccccaaaagcaaatgcaacaaaaacaaaaataaatgcgacctaattaaacaaaaaagcttctacacagcaaaagaaataatcataagagtaaactgacaaccttcagaatgggagaacatatttgcaaattatgcatccgacaaaggaccaatatccagaatctacaaggaactcaaacaagtcagaaaaataaataaataaaacccaccaaataatgccaccaaaaggtaaaaagtggacaaattacatgaattggcatatctcaaaagaagatacacaaatggccaacaaacatatgaaaaaaaatgctcatcatcagggatgcgtaaattaaaaccacaatgagataccaccttattccagccagagtaataagtcaaaaagcaatagatgttggcatgggtgcagtgaaaagagaacacttatacactgctggttggaatgtaaattagtacagcctctatggaaaacagtatggagcattcttaaagaactaaaattagatctaccatttgatccaggaatcccactcctgggcacctatccaaagaaaaagaagtcattatatcaaaaagacacctgcttatgtatgtctatcatagcataattcataattgcaaacatgtggaaccaacttaggaaccaacctaagtacccatcaaatgatgagtggataaataaaatgtggtattgccaggtgcattggctcatgcctgtaatcccaacactttgggaggctgaggcgggcagatcacaaggtcaagagatcaagaccatcctggccaatatggtgaaaccccatctctactaaaaatacaaaaattagccaggcatggtggcatgcacctgtaatcccacctactcgggaggctgaggcaggagaatcgcttgaatccaggaggcggaggttgtggtgagctgagatcatgccactgcactccagcctggcgacagagtgagtctccatctcaaaaaaaaaaaaaaaaaaaaaaaaaaaaaagagaagaaagaaaatgtggtatatatataccatggaatactacccagccatgaaaaagaatgaaataatgtcttttgcagcaacttggatggagctggaggtcattattctaagtgactcaggaatggagaaccaaatactctatgttctcacttataagtgggagctaagctatgggtacacaaagacaaacaaagtcgtataatagacattgaagattcagaagggaggagggtcggatgggggaagggataaaaactacatattgggtataatgtacactacttgggtgatgggtgcactaaaatctcagatttcaccactatacagttcatccatgtaaccaaaaaccacttataccctgatataaatatacatatataatatataatatatgtaatattatttttagatatagtaaaataaaatatactgacaataccaaagattaatgagattttagagcaactagcattttcatttattgtgagtggggacacaaaattacctgaacattttttagaacttttcacagtttcctatgaggtaatatctaaagagaaatgaaaacatatgttccccaaaagacttaactagaatgattatgacagcctttctcttaatagctcaaacctggaaacatcccagatatctatcaagaagagaatggataaaccatttgtggtatattcatgcaataaaatactactcatgagtaaaaagaaaaaagtgttgataacactcaataatatggatgagtctcagaaacatgttgtaaaagaaaccagacaccaaagagtaggttctcaattactcattatttaaagcttgagaacaggcaaaactcatgtgtggtaatagaaatcagaaaatgactggggagagtagaagtggggtaaagtgagataattccctggaatgctatattctccatctcaattgaggtgacagttacacaggcatatccagttgccaaaacccactttttataattgaacaagcactcgattttttttttccccgagacggagtcatgctctgtcgaacaggctggagtgcagtggcgcaatcttggatcactgcaacctctgcctcctgggttcaagcgattcttctgcctcaacctcccaagtagctgggactactggcacatgccaccacgcccagctaatttttgtatttctagtagagacggggtttcaccgtattggcgaggctggtctcgaactcctgacctcgtgatccgcctgcctcggcctcccaaagtgctaagattacaggtgtgagccactgcacccagccagattttttttttaccattaaaagggcacttaagagttgtgcattttattgtttgtaaattatacctcaattattattctttttttgagacagagtctctctctgtcacccaggttggagtgcagtggcgcaatctctgctcactgcagcctcctcctcctgggtccaagtgattctcgtgcctcagcctccccagtagctaggactacaggctcatgccaccatggctggctaatttttgtattttttggtagagatggggtttcatcatgttggccaggctggtctgaaactcctgacctcaagtgatccacccacctcaggctcccaaagtgctgggattacaagtgtgagccaccatgcccagcccaagaaataatttttaaaataatttttataccgtagttgtttataaagctttccatagtaagttccttcttatggtgaaatcagccattctaaaggcaaactagaatatataatactatagaatttgactttttttattgtgaacatggtatttgtcttctagagcatgtcccttttactggcttccattctttttcctggtccctaattgtttcagttcagttttctgccttttcttgttttcttttgtagaaagcatttattctcatagctttatcagtttactatagcctgccccattatcaaaatctctagtattgtcctttgttctgaattatatttctgtttcctcttgcttttgagtcttggttttgatttccctactaatacttcaaataagcttatttaaaactaaattgacatctttctcctaatacaacccgtccctctttctgtcatatacgtaccattctcataatcatctatgccaaaatctttgcaattatgtttgcctgttcctctcttcttgctctacttcctgatttagttttcacgtcctgttgctttttcttttttctctttttgccaatatattattatgcaaaagtttcaacatataggaaaatgaaaagaatcatacagtgaacatacatatgcccaccactaggatattacaattaacattttgctacatttgcttcttcacatgattattcatttattctttctctatctgtgatttttcttttatattatatattcctttccattctcctaatcactacacacttggattattcttggtctttcttcctccagttatttctctctctttaatacatcttttatgccagtggttttcaaaatgatcatactcaaactatctactggtacccagtagaaaatattagaactaatttttcataatgttgttactgaaagaaaaagaaacaaactaagcttcactactattttacatacagattggtaatggcattcttactgattccgtatgtcggattatcacatactctaaccagagtgccttgagggaggaatggatgagacacctttgctcttttttcaaggacactgtgaaattttacagttgatttgtgcccagttaagtggatttatagactagttatatagtttttaaactaacctcacataaaatggaaatgtcactttaaaagatttctacaaaaacactactgattgaagatgatacaaataggcaaacccagactaatagcaagaaaatggaagaaccgatactgtttgtgtatcatatatgaccatatataagcttttttcaacttcaaggtaaaatcatgataattgcttgtttaatcacctcctttaaaaacatctatttttgtatatgttttattatatacatattagaagaggggcagatgtcagattttttactaaaaaggctacatgatcaaaaaaccttggagatattatgtaagaccaaattaatctttctaaaactaattttctatctatctctcccttgctgtccattgtcagcagagtaaagtccagactccttggttaagtattaaagattttttataattgaatcatattctatatttatttttcaaagtattctcatgtcataaatctgacatatttttcgtctttgccatatacccatttcttctgccaggaatcagtcttgtttcctgtgtctacctggctcatacctattatccttcgaagctccaatctaaagtataatttctttgtagccccttctgtcattttcttgcaagtcagaagtagacgtcctctcctctgtgctcagtagtaccatatgacatgtctctcttgtagcagttatattgcattgtaactagataccacactcagagcaatgatttttgacacattcatctgtatatcctttcagtagagacttcaatgtttgaaaagagggaaagagggaagagagggagggagggaagaagggaaaaggaagagaaagggaaaaaaagaaagaagctactctatcctccagattattttggtcgcccttttggaaatacttttcaatctctataaggctctgaggggccaataaataataagcccgtcttcattcaccagtttatagtcaatagagaaataagacaccagagacagacagatgaagtcagaatgtcagcaaatgaatgttagccctgcatgtacatggccttgctgttattttacccctgcaggagggagacatgagtacttagtctttggcctctgtgttcaactgcaagcctcctcccaacgggcagacatggcagagaacagaccagaatacgcctctgcaggcaggctgttaaccaaaacagtgagagaactcaagagtccctgagccaagcatattgagttcattgtgtaaaactccccagtcagataagacattctttcttccttggggaagaaagtgaaggggctccgagaaactggaaatgttcctcccattctttattctctaaggaatttgaagaattggatgaacatttccccctaatgctctttacattaaggctgaacatatgtcttggttggcccaggactgatccagctttttcctgttgccccaacataattattaatagtatccccttttattctcaaaagtggacagtacattttatgatcatcctaagtatatttttcttaaaatagaatgatcaaaattgcattcagtattctgggaatgtttgaaactctttaatatgggctactctcccacttacaaaactgggtacacctttttaacattgcctatacttatcttcgggggagcctacaatttagaacattgagtctatttgttttatgctcagccagccttttccactttcctctctacactttgtctccccacgtaatagccccacggaagactattttcaggatgaactatgtgtgattcatattagtattctctgcagtgctttgcacagagtagatgctgaaaagagaagaataatattttaagtgtaggttttataggttaagatattgtttacattctgctgaacatttaagatcttctagaaagaccttacagtttctaaaacatgcccttttcttcccagtcttctgatattctgaacacagctgtgtattcaaatacagtgtaaggacacagcttgaacagcttggtttaattgatgtacattttatcttctattcaaataaaatagtgttttggttaggtagttgtcttgaaaatacaacattaggaattcgttttaccctcaacccatcccatttctcttatgatgaaagaaagattaaatttttgctaaaggcagcttacaaatatattgaatgttgatatttcagagcttagagaatgattaaaaaaattatcaactgaatagagctccaccatgagaaaataattgtaattcttacatttaaacaagaaaaatcctatttggggaagaggaaagaaagataaattcatgggatttagaaccaaccagctgcttgatatgcccaaaatagttttgtcttttgaaatagctttttaggggaatactttggcttcatacacaggaaaagatggttaggttaggtctttcctgtatcaaaaataaacaaacaaattttctcttggccctaaccctccccatagtttttatactatcttttccacaagcaaatttttgttttaagtcatctattcttaaggactctacttcgtatttttctcttcagttactacagtattctgacttttgcctcctaccttttcagggttaccagtaacctcctgatcttatagactctttttagcccttatctttatgcctaacagctttacaaagcgtttttttgtttgtttgtttgtttgtttgttttgagacagagtcttgcactgttgcccaggctagagtgcagtggcgcgatctcggctcactgcaagctccgcctcctgggttcatgccattctcctgcctcagcctccccaacaaagcgttttttaatgctgaccatgcccttcctcttctgtcttcttttacaccattccccctgatgattcttactttctccatctgccgcttaaaatgttagtgctcctaaggttctgttcttcacctttctctgctcagtttatctaggtaatcatgtctgctgtcatagctttaactacaatgtctctcaaatctttatcttcttatatttctctttggagtaccgggttcatacggccaagagcttgttatttatctgtaccaggatgttctacagatcactcaaatgtaacaccttcccttcctgccttcaacagatatgacatccccccagctgcttgagccaaaaactggttgtcatcctcgcctttccctcactgtctcctctctgttgcagttaactaccaagttctatcaattctaacttttaaaaacctgccattcgggtggatcacgaggtcaggagaccaagaccatcctggccaacatggtaaaaccctgtctactaaaatacaaaaaattagctgggcatggtggcacgcacctttagttctagctacccgggagactgaggcaggggaatcacttgaactggggaggcggaggttgcagtgagctgagatcatgccattgcactctagcctggcgacagaggaagactccatctcaaaaaaaaataaaaaataaaaacctgccatttcttgagtgtccattggtggtagacacattactaggcacttttaatatatcatctgtctcctaaattcctctaaatccacattaatttctaatttctattcccacagccattttcataattattcttttttttttttttttgagacagactctcacactgttgcccaggctggagtgcagtgatgagatctcagctcactgcaacctccacttcctaggttcgagcaattctcctgcctcagcctcctgagtagctgagattacaggaacctaccaccacgcccagctaatttttgtatttttagtagagataggggtttcaccatgttgctcaggctggtcttgaactcctgacctcaaatgatctgcccacattggcctcccaaagtgctgggattacaggcgtgagtcaccgtgccggcccattttcataattattcaataaatatttgataatgtatcacttttatgccacaaaagctagaaacctgggaatcatctttgcctctttcctcccttcccttcctcaatcctcatggtagtcattaagttctgttactttaccttctttgttttattatccattctactacccctgccttagttccagtcttcacaagttcttatgcagtctattagtgtttatcttatttgtctgcctttattctcattgcacaccatctatttcgtcctttattactgcttcccataatctttttcaaatataaattaaatcatgtcacagttcaccttaatcaattctctatcatcgtcaaaataaagatcaaacttctcaacacagcactctaagaatgttggaattttgtgcttgttcataaaattcatttccctttgcatacaactttcattctagtttaccaaattatttgtaattatggaaaataccaagcattcttaatacctcaatgccctttaatctatctggaatcatctccctctccctaatcccaacttatttatttatttatttatttatttatttatttgactcggtctatcaccaggctggaatgcagtggcacgatcttggctcattgcaacctccacctcctgggttcaagtgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcagcttttagcaggctttcctgatagcaatcttaccaggcaattggtattcctctgcactccccaaaaaagattatgtttatctttatcttatcatttatctcttctgtcttcctgtctagactataaactccttgaagtcaagaactgggttatatttctaatttttatttctgcataaggatgatggggagaggaggatgagaagggaggaaggaaaaaagaataaaatgaataaatgaattgatccactaaatagtgtataaagttgctaggtattttagtcttgatttttattaccttcactttaaatgagcaaataataaccacttctttatctgtattaaattgccctgtgtgaaaacaaaacaaaaccaaacaaaaaaaacttgctaatggtatcagtggtaaaggtgtaaaattaataaagtaacccagaagataaatggctgcatttgtttgccctcctaaagaaaggactgttaatctcttagttgctaattaccttgagtgctaactaaaatgctaaatcaactttcaagttaagattaaaatatatttatgttgatcttttatccttactattagtacatcccttttagtgaatttttcagatatcaaatggactatttcagctatttctatagtccttaatttctccaaacttctctaaagacaaaacataaatctaattgtggtacagttgtagaattcctccttactcagctctattcagttcccatgctatttcaagaaaatttctattaaagaaaaaaatatttttcatggaagatccataactgttatagtgcagttttacagatatattcaaaaaaattactcttatccatgaaacagttgtttggcgataaaatattatatctatttgatagatttgcttcatagctaaggaggattaaagtgaactaaagtacatctcagttctttttaatgttttgttctcttctcacatatttcaactattttagtatttcatttgttctcatctttcccacctgagacatttcaaccaggtccttcaaaggaaaaacacaaaaactcatcaaactttgaaaccaccaatcaatatatatgcagaaaagtatggtggagaaatggggtaggggtaattcagacattttcaccaggaggctagtcatctgttcttttcttatattctgaatgcagaataataatttttcttagagtaaaacagtatagcttgtcaagtttattataatggaatttttacttacaaagttggtatgtcataactgaggctaaatgatataaaactaataagtcttgtgatgctttctaaacctgtttgctgtccagcgtactttttgtgtgtgtgtctttcagcagagcagaagcattcttaagagaaattgaaaataaaagcgtgggacatcatagtgcacaacagtggacttttaaaaaaattcttttttgctcaactgctatataaaatggataggactagaaccacctgctaggaacattcttcccaacttatccatgttttactaataagatggttcttcagaaaccttaactttacaaggaatgcagacaaagtgggagggaaaagattcacattcacattgaaaagctcatgtcagttcatgttgaaaaggctagagatttgttttaactttcagaaattcaactaccttcagtatttctggttatattttattggtcacttactgagaattagtaatatataaaaatgctatgtaaggtatttatttgttatcattcacaaatacagattacacaaagcactgtggtagttagattagtgttccttcagatactcagatcttgttcaccaagagaaagcaggtacttttgtaggttttaagcaaatctagattgctcacttgaaatgacaaaagtccaaggctagggtttcctttgaggagaagtgggtctgaacataacatcaaaaatgactatgtataatagtaaaaaattgaacagatacctgcttcttctattggactacaagggtaaatatgtcttgtgtcagcatgatcaaggtttttaaatgaaagaagtacacagtaatttttattagcatttttatggcttgtggttcatatgaacacctttttgtttaatgccatcttctgttctgggcttctgattgcttgctgaaattctcactggctggtgaagaagccactcagacttaaattgtgtttgttccttgaaagtgagccctcagctttctgacacccaaatattagtataatgaaataataaattcactcactggtgaattcttttctgtcagttttgaatctggcatttcactcaattttctttatttacagagcttccttatggctgggagaaaatagaggaccctcagtatgggacatactatgttgagtaagtttgttacctcagttaatattctcccaaatattttcctttcagcatatagctttagagaatactggatacagcactttatgcttctgtgatccagctgttgagtttttcaactaggggaatgaaaaggtaggggcagtgagcatttgcttcattgaccttgggcttcctggaagttggctttgaatttctaaatatagagaataagggggaagttgcctagacaattaatagctagagatggtattgttactactacagcctctaaagagaaagtcagttgatagaaaactgaaatgagggcaacagactagatgaattatcaaggtcatttccaacactaccactgtatccttctgaaagcagtggaagatctttagggcattataacataattatctgaagttttgaagcatacacctaaaggtgtgctctcttttaaggagttattcaaggaaaacttagtattctttttaggggtgaaagttgcttcttaggcagctgctatggttaaatttaaacataaatatatattggagaggagtgccagacacctgcctatgttagccagagaaattaagctaatatcaatgtctaattttgccttctcttttctttatctaattgctacaatgttatgaccattgggattgctttctttccagatgctaaacactgaatttgacctcaagcgtctagcagcaggcaaatacttctatcagaaacattactatttacctggagactaggagttaaacctgctgcctaggtagcaaagacaaaatgttattattacctgaaaaagtaacaaacacaatcatctttaattttataattgtttcttaatgtttcaacacttataggcataaaccaatgccatttcctggtagttatccctaaagtaagtatctctgactcctgttgcaactgtagtctttattctattgtgcaggttgttacttgagtcactgtggttagagggatttttggaatgacttcttaaaattaaatgtgtctcctaaggaaatgactcaattagattgacacttaagtatataactttagaatttcaatatcttggttcctttgaaagctatgctaattttgtttccattgtgttacttaatgtcttactgatactgtgatgtaaaaagtatacagcagctcttttattattattttttcctaagacttattttgttaaaggaagaaacaaccatttttcacatcaaaggagtatttgggggccgactgaaaaggttttgcaggatttttttcttcccctcaaagtttagtctatttaaattgggctctaatcagctatttgccattgacactgctgaacatttctgagataatgattctcattctctttattatccattccaagtgaatttgaatacatggtcaaaaggtgaaagtcatttgcctgttataaaaccttgagctgaatgatctggtccccattatgcaaagatataatattaaagcaactttagggcaaatcctgaagcgacctgctcctagttgtcagggaggtacatgaaatagcctgaattagaagcaacagcagcagcgacatgattttgtatgattattcccagaatgagctcattttacaggagggttttgtattagactaagaaggagcagactgtactcaagatgcacattagtatggagtcagctgagctgtggagtgtggcttgattcccagattagttaggttttgaatctcgaccatagtaatctgcagtgagtttactgatggagataaaaagctgttacttgaatggctactctttggctctcttagtttgtcaaaccagatggcacgatgattgctcttggcaggagccttgtagtagtaacaccaactgcagtggtagtttttctttgtatttattttagaggatgggattctgaaatggatgaagttattttttaaaataaaatttttccaaaaatgtaatatgcttataatatgcataaatataaatatgcataagctataaatatgcttatatatttagaaatgcggtcttgattatattgcattacatgtctttttaaaattaacatataattatacacattttgggggtacgtagtgatgtttcagtacacgtaatatatagtgattagatcagggtgataagcattaaatgtcttgatgcacctagatgacaaagtcaaaatatatacttgctttcacaactaaaacttttttttttttttttttgagacggagttttactcttgcccaggctagagtgcagcagcacgatcttggctcactgcaacctccgccttctgcctcccaggttcaagtgattctcgtacctcagccccccagtagctgagattataggcatgcgccaccacacccacctaattttgtatttttagtagagatggggtttcaccatgttggccaggctggtcttaaactcctgacctcaagtgatccacccgcctcggcctcccaaagtgctgggatcccaggcgtgagctaccatgcccagccatctaaaactctttatgaaagaatattttgttgagataaatttttaaatccagatattagacataaaattttaatacagaaaatgtgtcaaattgtgtactaatatttaatcattcttgtttgctttgtttctttctgataatctgtaatattctcctctcttatttcccacagctagttatttggaaaacaaaatttgttgtgtcttaataatagtgtaggtataagtaattaaatgaaaaggacagtattttcacttttttattttttgattttttttgagtggcattttagtctagatagtctaagataatgaagacaataacttccttcagtaaatcttatattcttttgtcaaatttttaggaaaaggattactcatttgcatacgtctactctcctctcccacacattacaaagggtataaatacaaattactactttttatgttctaatgcctgggtggcaaagtgagtcattctagccaatgactttaaagtgaaagtgagccaaggttctttctgaacaggtttattcttttctgagtgtcaatttttagttgtttttcaaaagaatatgtaaaatatcagtacctaaataaattttttaaagtagttcctaggatttttattttcacagagttaaacagttaactcagtggacagtgtatcccccgcatattatgaagcagaagcatacttgagtgtcagtgaaatcagaacccaaacaatgtccagtggcacttaccatatttagagctcttaaactatttaataagtaactacgtctgttgtggaactgatatgtagtagtagcctgagtgacatggagaaagctaacattcctttttttgaaagtgtttttttaatttttaaatttttattttagtccctgctgcccatttctctaccaccactcttaatgtttacaaatggcaaagctccagcgtggacaacatagtaagaccccatctctacaaaaaaaaaaaattttttttaattagctgggcatggtggcacacacctgtggtcacagctactcaggaggctgaggtgggaatatcgtttgagcctgagaggttgaggctgcagtgagctgtgattggaccactgcattccagcctgggtgacagaatgagtgcctgtctccaaaaaaaaaataaataaagaaataaaaaggcaaagtaaatgttcaacttgtgtgactatttatatgtacattttgtaatattcagtctacctaaaaacaatcatgttctgaaattctcatgatttggtatttaattgttggtgttcactcatatcacctctttatttttattttttattttttttgccgtggagtttcactcttgtcgcccaagctggagtgcaatggcatgatctcggctcactgcaacctccgcctcctgggttcaagtgagtctcctacctcagcttcctgagtagctgggattacaggcatgcaccaccacgcccagcttatttttgtatttttagtagagatggggtttcaccatgttggccaggatggtctctatctcttgacctcgtgatctgcctgccttggcctcctaaagtgctgagattccaggcgtgagccactgcacccggcctcacttctttaattaaagtggaaaactgtagcatatgctgaaatatatttgtactatggaagtgttagaatatgatttccattgcttctgaattagacctattcgaggtcctaaacatcttttttacagcatttcctttcttaaccaactccacttaactggcttgccagaagaatagtgctctttttcttctgtaaaacatactatcgcccatagcgtgttgaatagtttggctaatctcctagcggctagtctccccaggcttcctgctttctctcagagagttgtatgcattccaagagtcagtagtgaatgttcccaaatcataaatgccagttgaacctatgttataattattcatttaattatgatataattatgaagaaatttaagtgtgaaagagttattctatactatagttgataaaagcaagtcattttcttagttgctactgaacggatataggtgagtcagtggaaaagtaatagtaatataatttaaaaaggattctatacacaaatttctttcaaagtgcctttacagcttgcttcattttggagaaacttaaattaaaacccttctatcattaactgccttttttaaaaaaattaaattaccaagaacaagtacttctgattgcatcagataagaaggctatagttttgaaaactgttattggctatattgggtacgtttatgaagaagctatagtaaatataatatcaaaagcttcacagcttggcatcttctgcaggactttatttagcagcagaaagcccctctgctatcatctatcagtctctccatgttccatagcctaaagatacatatttgtcccctaatctatgatgatggaatggtatgatagactatttaagaatatgttactgttttattttaaactgaaatgtatatttttctgcattctacagtcaccttaaccagaaaacccagtttgaaaatccagtggaggaagccaaaaggaaaaagcagttaggacaggttgaaattgggtcttcaaaaccaggtaagcattcttttcaatcttttcttctaagaataacttgtgaaatttgtatgctgagttaataaaagtgagtttgaacttcttatttctatggctttgacactaaagagtgtctagttgttactgtaaagatatgaataatcttaataaaacatctgaacattatcagaatactgagatttttctcaggagtatacaaaaagcatgaagttgttgggagaagggatttcggcagcttttttatgaatttgagattttgttttgaagattggaatgtttccttatgtttaaggctagaccaatattaggtctccagttcatcgttagcttttcccaagttaattgcttaagtatggtatctgtaaccactgaggattcttcattaaccaatattaataaatactaaatatatcaaatgatttacctacatcattgagtctcaaatgggatggtagctattagtaacatcagattcatttagggagcatttttttaaaaatatagatccagaaatttcgatgagtctaatcatgtgtattttgaaaacactgctcaggaagttcttacattctacttatccctccccatcccttttccagccctcatttgtcattaataaccaggggtatatatggccatattgtagtaatccagtagattctccacttcggttgcctatgagagaaatagttctttcttatagttactcttcaaaaacatcgtcctcctcctaaagttctgcatttcgtttagcaaacattttgagtttaacaaatacttttgagcactgactatatccccagtgctttgctaggctctaggtattcaaaaatgactaagagtaagacagggcttgccctcaagagttcatagtctaatacaggaaactgatggttataatacatggagataggtgccatcatagagtagtagttataatggtaagctgaggagcaggtttgaatcccagctgtgtaatcttgggtacgtttcctaaatctctaaatgctcctatttcttcatatataaagtaggaataataatggtacccaccttttaaggtggttatgagtatgtaaattaacagatgtaaagtgcctacaatggtattaagcacatgttgactaataaatgatagtttcattgttattaatagacatgtacaagttacagtggtggcataaagacgggagtacccaactctgctttggtgggaaatgtcaagtgggcaggagaaatttcaaagcagaagagatagaaactaggtcttgaaaagtcaggaaaagttaaagcaggcagacaaaaattttaaaggagcaagaaagcataccaagtagaaggaacagaatgtttaaaatcacagaagcatgaaatggtgtgccgaaaggccagaaggcaagtaggtgtggttacagcatagggtatttgtagggtagtaacaagcgatgaggttgtagggataggcagccatgagaagaggttgagtatgtcatatgttgctggaatgtcaaggaagttgaagattgaaaaatatgtgttggatttgacagtagggaggtcattagtcactctaggaagagcaagtagagagtgaagtaaaattgcaatagaatgaagagggtatgggaggtcagacagtacaactgttggcaaaatgataaacataattaccatatatttatagtaactgctggaattccactcagtgtatacccaagatgaatgaaaatatgtccacacaaaaccttgtgagtgttcatatcaacattattcataatagccaaaaagtggaaataacccaaatgtccatcaactaatgaatggatcaacaaaatgtgttgtttatccatacagtgccatattatttggcaataatataataaatatattttatctttagtaagtacatatttaatttaatatttattatatattaataataaagagcaataaagtactgacatatgctacaatacagatgaccctcaaaaacactgtcaagtgaaagaaaccattcaaaaaaccacatattgtctgattttgtttatatgaaatgcctatattgggcacatctatacatggatagtagattcgtggtttcctaaggctaggatatggatgtgggttggggagaaattggataatgactgctaatgggcatggggatttcctctgaggagggaagaaaatgttctaaaattagattatgctgatagtcgcatgacattgaattgtacacttgaaagggctaaattctatggtatgtgaattatatctcaataaatttgttaaaaaatagataatggcagaacatttaaaatcttttttacagttaatttaatacttcataaattataaacctgcacaatttgattctctcagtttttgtcactttcctaatggcaggcatggttgaggagaagagagaagaggttctggaaggaagttgttatttgcagatgtgaatcactagggtcatctaacccctaataatgggcatttcaaaagaactatgtatttttttttcctaaattatccactaaacatgagtgaaagggatagaaatatgaagctatttactgatagtaaaaagattcactccttccatcagttataaatcaaagactgcagaaagcctgagctgtgaattataaaaattctcaatatactctctttcataagtttgtgacacttgacttcatcttcctggtatagtactttgcacataaaactcagtagatgctgagttttatagtacagttgaatagtatccaaactttcagaaattgagtgctaaaggttgtatcattttgacttcatataatggactctgggttgaaagtaagcacagacaaggcaatgagaaagagattaagttgagaataacattaaaaagtcatataaaagattgactctgagtgctatattcattgtaattatttttgttctcaaacccacttctcattttggcacagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggtaagaaatttttcataattatttgaagagtagtgatactataacaaaaattatagtgaagagattttatatacataaagagagagaaataattaaattatataactaaagaaagagattccagtattaaaatagtttatactttaatttaaaaaaaagttgtatgggtatacagtaggtatatatatttatgggatacatgagatattatactatgatacaggcatgcaataagtaataaccacatcatagaaaatgtggtatacatctcctcaagcatttatctgttgtgttataaacaacccgtttatactcttttagttataaaatatacaattaaattattgctgactgtagtcaccctattgtgttatcaaaaactaggtcttattcattccttctagctatatatatatatacacacacatatatataatacacatatatatacacacacatacacacacacacacacacacacacacacacacacatatatatatttttttttgagacggagtcttgctctgtcgcccaggctggagtgcagtggcgcgatctcggctcactgcaaactccgtctcccgggttcacgccattctcctgcctcagcctcccgagtagctgggactacaggcgcccgccaccacgcctggctaattttttgtatttttagtagagacgaggtttcaccatgttagccaggatggtctggatctcctgacctcgtgatccgcctgccttggcctcccaaagtgctgagattacagacgtgagccacaccgcacccggcctttctagctatatattttttatattccttaaccatctccacttccctctcaccgccccaccaaccctaactacccttcccagcctctggtaatcatccttctactctctagctccattagttcagttgttttaatttttagcatccacaaagaaatgagagcattcaaagtttgtgtttctttgcctgacttatttcacttaacataatgatcttcagttccatctgtgtcattgcaaatgacaagatctcattctttttatggctgaatagtactccattgtgtatatgtaccatgttttctttatctaattatctgtcgatggacatttaggtggcttctaaatcttggctattgtgaaaagtgctgtaacaaacatgggagtgcagatatctcttcaatatactgatttcctttcttgtgggtatatactcagcagtgggattgctagatcgtatggtatctctatttttagtgttttgagaatcctccaaattgttttccatagtggttgtgcaaatttacattcccagcaacagtgtatgagggttcccttttcaccacaccctctccagcatttgttattgcctgtcttttggataaaagccatttttaaccagggcaagaagatacctcattgtgcttttgatttgtatttatctgatgatcaatgacctgagcacttattcatattgctgtttctatgtcttctatgtcttcttcatgagaaatgtctattccaatgttttgcccattttttaatcagattattagatttttcctatagagttgtttgagctccttatatattctggttattaatctcttgtgagatggatagtttgcaaagattttctcccattctgtgggctgtctcttcacttgactgattgtttcctttgctatgcagaagctttttaacttaatgtgatcccatttgtccatttttgctttagttgcctaggcttgtggagtatcactgaagaaatttttgcccagaccaatgtcctggagagtttccccaatgttttctttttttagttttacagtttgaagtcttagatttaagtctttaattcaccttgatttgatttttgtatacagcgagagatagaagtcaagtttcattcttctacatgtggatatccaattttcctagaaccattgaagagactatcttctccaatgtatgttcttggcacctttcttgaaaatgagttcattgtaggtgtatggatttttctattctgttccactggtctatgtgtctgtttttatgccaataccatcttcctttagttactatagctctgtagtataatttgaagtcaggtaatgtgattcctccagttgtgttctttttcctcaggctagctttggctattctgggtcttttgtggttccatataaatttcagaattgttttttctatttctgtgaagaatgtcattggtattttgatagagatttgatagagattgcattgaatctatagattggtttgggtagtattgaaaagaatattgattcttccaactatgaacatgaaatatcttttcattttttgtgtcctcttcagtttcttgcatcagcattttataatttttaatgcagagatctttcgcttctttggttaagttaattcctaggtatttaatcttatttgtggctattgtgaataggattacttttttatttctttttcagattgttcactggcatatagaaaggctactgatttttgtatgtcgcttttgtatcctgcaactttactgaatttatcagttctaatagtttttttatttgtggagttgttaagtttttccaaatataagatcccatcatctgcaaacaaggataatttgacttctccctttccaatttgtatgcctgttatttctttctcctgctgattgctttagctagaacttccagtcctgtgttgagtaacagtggtgaaagtgggcatcttcattttccagatctcagaggaaggactttcagtttttccctcattcagtgtgatactagctgtggctctgttgtatatatggcttttattatattgaggtatgtttcttatataaccagtttttttagggttttatcataaaggggtgttgaattttattaaattttttcagcatcagttgaaattattatagtttttttgtttttgttttgttttgttttgttttttagactgagtctctgtcacccaggctggagggcagtggcatgatctcagctcactgcaacccccacctcctgggttcaagtgattctcctgcttcagcctccagagtagctgggattacaggcactcaccagcacgcctggctaattttatatttttagtagagatggggtttcaccatgttagctaggctggtctcgaattcttgacctcaggtgatccatctgcttcaaatgattatagtttttatccttcattctgttgataccatgtatcacactgattatttgcatatattgtaccatccttgcattcctgggataaatcccacttggtcatgatgaatgttctttttaatgtattgtcaaattttacttgctaatattttgttgaggagttttacatcagtacttatcagaaatactggcctgtagttttcttttttttgatatgtctttgatttggatatcagggtaatactggcatcacagaatgagtttggaattattcttccctctatttttcagaatagtttgagtaggaattgtattactcctttaaatgcttggtagaattcagcagtaaagccatcagatcctgggctttactttactgggagactattatggcttcaatcttgttgcttgtcattggtctgttcaggttttagatttctttgtggtttgatcttggtaagttgtgtgtgtctaggaatttatccatttcttctaggttttccaatttgttggcatatagttgctcataatagtctctaacaatcctttgaatttctgcagtatcagttgtaatgtctcctgtttcatctctgattttatttacttggatcttacctctttttttctgttagtctaaggtttgttaattgtatcttttcaaaaaaccaactttttgtttctttgatcttttgtgttgttttcttcatttcaaattcatttatttctactctttctgcttttcttctattaatctagagcttagttttctcttttctagttcttcaagatgcatcatgaggttatttatttgaagtttttctttttttatatatataggcacttatagctataaatttccctcttagtactgcttttgctgtatcccataggttttggtgtgttttgtttccattattatttgtttcaagaaatttttccaatttccttcttaattcctttattgactcactggtcattcaggaacctattgtttaatttccatgggtttgtatagtttccaaaattccccttgttattaatttctgattttattccatagcagttgagaagatacttgatataattttaattttttggaatgttttaagacttgttctgtaacctaacatatggtctatccttgaatgatgccgtgctgaggagaatatatattctgcagccattggatgaaatgttctgtaaatatctattaggtccatgtagtctatagtgcagattaggtctgatgtttccttgttgattttctgtctggaagatctaatgctgaaagtgggatgttgaagtctcctgctattattgtattgaggtctatttctctctccttagctctaataatatatatcatatattatataataattatatatataaaatatataattgtaatatatgataaaatacctctctctttagctctagtaaagcaagtaacacttgctttatgtgtctgggtactccagtgttggatgcatatacatttacaattgttatatcctcttgctgaattgacccctttattattatataatgacctttttgtctcttcttgcagtttttgtcttataatctattttgtctgatataaatgtagctactgctactgttttttggttttcactggcatggaatgtctttttccagtcctttatttccattctatgtgtacctttacaggtgacatatgtttcttctaggcaatagatcatcaggtcttgctttttttattcactcatcttctctatgtcttttgattggagagtttagtccatatggattgagtgttattaatgatcagtaaggacttactcctgccattttgttatttgttttctggttgttttgtgattgtctcttccttatttccttccttccttttagtgaaggtgattttatctgtggtatgatttaatttcttgctttttattttcttgtgtatccattgtatttttttatttgagtttaccaggacgctagaaaatactatattataactcataattataaactgaggacaaattaacactgattgtataaacaaagaagcaaacaagcaaaaagaaaatgaataaaaactgtacaatttaacttcatcccttccttttaaattttttgttatttctctttatgtcttattgtactttgtcttgaagatttgttctagttattattttgattggttcattgtttagtctttctacctaagagtatgttacccaccacaattacagtttaatattctatgtttttctgtgtgctattaccagtgagttttgtaccttcagatgatttcttattgctcgttaatgtccttttctttcgcattgaagaaccccctttagcatttcttgtaggagagatctagtgttcacgaaatcccttagcttttgttgtctggaaggtctttatttctccttcatgcttacaggatatttttgccagatacactattatagagtaaaaggtttttttcctaagcactttaaatatgtcatgccactctctcctgccctgtaaggtttccactggaaagtctgctgttagacatattggagctcctttgtatgttacttgtttcttttctcttgctgctcttaggatcctttctttatctttgacctttgggagtttgatttttaaatgccatgaggtagtctcctttgggttaaatctgcttggtgctctataaccttcatgtgcttgaatattggtatctttctctaggtttgggaagttctctgatattatccctttgaataaactttttacctcattttttctgtacctcctcttttgggccaataactcttagaattgcccttttgaggctgttttctagatactgtaggtgtgctttattgttctttattcttgtttttttttgtctcctctgactgtgtattttcaaataggctgtcttcaagctcactaattatttcttctacttgatcgattctgctgttaagagactctgatgcattgtttagcatgtcagttgtatttttcaactctagatttctgtttgattctttttaattatttcagtctctgttaaatttatgtgacaggattctgcatttcttctctctgttatcttgattttttgttgttgttttctcaaaacaactatttttaattttctatctgaaaggtcacatatctctgtttctccaggattggtccctagtgccttatttagttcatttggtgaggtcatgttttcctggatggtcttgatccttatagatgtttgttggtgtctgggcattgaagagttaggcatttattgtagtttttgcaggctgggtttctttgtgcccatccttgggaaggctttccaggtattcgaagggacctaggtcctaaacccaataacaataagtaccaccttggtattcttggatacgattcagaagaattatctggattaataggcagagactcttgttcttttcccttacattcttccaaacaaacaaagtcagtctccctctctctctctctctctctctctctctctctccctccctccctccctccctccctcactctctgtctctctctttctctctctctgtgctgagcctcttggaactgggggttgggggacataaacatccctgtggccaccaccactgggactgcgctgggtgagacatgaaaccagcacagcactggatcttgcccacagccagctgtaaccactacctggctgccacttaaattaactcaaggccctggagccctatgatcagcaggtggcaaagtgagctaggttcgtgtccctctcttcaggatggtgagtttccccaagccgcgagtggattcagagatatcgtctgggagctagggattgaagtcaaaaaccttagaaatttacctggtattctattctattctggctaagctggcattcaaaccacaagacagacagaattcttcccattcttcaccttccacagacagagaaacctctccctgtggccaccaacactggcccatgtgggtgtgtgggggtgttgccaggccactgctaatgctcacctaaagcacaaaggctcttcagtcagcttgtgatgaatgctgtcaggcctgggactcacccttcaggacagtgggctctcctctgatccagactaggtccagaaatgctgaccaagagcctaggcctggactcagggaccccgagagcctgcgtggtgctctaccctactgtggctgagctggtacctaagctgcacgacacagtcacctttacctttccccctacttttctcaagcagcagtctttcaccatagttaccacagcagggaatgtgctgggtcacgcctaaagccagcatgtctcagagcccagtatccgtggtgtatttattacctgggtattgctattggttattcagggcccaggggctcttgagcaggcaggtgatgaaacctgccaggtctctgctgtgacagggcagcactgagttcaatgaaaagtccatcagccactgtgctccccctctcacaatcacacagatttctccataccaggtggctgctaccgggagctaagggagaggtggcgtaagcactcccttagctgccctggctggtgtctcgtaggttgcagtcaggtgtctctgatcccagctcagcactaggacttgtctaggaattgcagtccttgtggcctagactgccactcatttcactcggggcccagagcactccagcccccagtggtgaggcttgctggaactcagtctccaatcactggaatgggcaattcccctatggctagggtcgacccaaatgctccctttgttggcatatgtcagctgagtacagcctggttctgctttcccttgtgacaggggagcactgagttcaatgcaaatcctgacaatcgctgtgctcaccctctcccaagcatgcaaattctcaccaccagtgcagggaggatgggggagtggtagcactggcaattccagactgcctttcctatcttcttcagtgtctctttcagtgatatgaagtccaaaccaggcactatgattgctcacctgctttttgtctcttgtaacggtacttttagtgtgtagttagttgttaaaatttggtgtttctgtgggggtagggggatgagtagtgtaggcttctatcccgccactttgctctgccctccgtcaccatctatcctctaaactaaatgcatattatctttgatggtgggccattttacaaacaggtgaaaactgttggagaaaacattaaatttattaatattttgaaatattttatataactttgagataatccttttgctgtataaaactaaagatttattaatcatctcagaaaaatatttgtttgattttcttgaattataaaggatacttttggagcaaacatttacctataaccttatttgaaaaaaaggtcctgtgtggtgtttatcatggtatcaaattattaaatcttgccgtttttcccaagtttgtttgcttccttaatcttactggttattaaattgaactcctatgttaagaattgtagacataacattaccatttttacaaagtagtgtaaacttgtcttttctatagtttcctaaagcctttacttggtaattgctggatattttaatatggctgggagtgtttgtggttcaggaacttggagaaggttgaagactagtttctgattgcggggggaagtttaagtattgttttccagaaagattttagtattaatactgaggttgctttttgcagtgtttgctagacttttctaatcctctgttatttcacataccgtgaaaatatggaccaacattcagatggttgaattgtcatagtattttttgatctctcatattatgctttcccattgaggtaacaaaaacttaaaacaggaaaacttaaaataatcaagttatacttgtaaagaaaattatttttttctactttattactttataaagttaacaaactttagagattaaaattaatagtaaggttcttttgttttcagttttgaccttttcaacattttatccatgaaacacatgtcttagctattgtgtatgctgtcaggatttcaaaatgtagtttcatatttgcctaatatgcttatctaatttgcatggcaatacaatatttccgtgaaaattctgggagctttaataccagattgagttttttaaaagccatcagaacaaattaaagcacctttgtttggcaataaccttttaaataatcatattcaaataaaagctaattgatgagacaacaggggccaaattttaagtcaagactgtattaaaaaatacccaactgatgaccgtcaactggtaatgattctacaaccaaaatagtcttactaatgtcaaatcaggaaagcaaaaccaacttttagagggatttattaagctgccttgtcagtgtcttcaataatgcattgtttgcttctgttgaattttttgttgcttgtttcaccttttgaaatctgatttatacatcaaattcaaaattgctggaaaaagaaggatactacaagaaaatacactcataaattaacatcattctaatcttcagttcaaaatttgtcaaactagaatgaatttttaaagtacattgttagcaatggcttttgttttgtttagttttttagttttttttttattattattatactttaagttttagagtacatgtacacaatgtgcaggttagttacatatgtatacatgtgacatgctggtgtgctgcacccattaactcgtcatttagcattaggtatatctcctaatgctatccctcccccctccccccaccccacagcagtccccagagtgtgatgttccccttcctgtgtccatgtgttctcattcttcacttcccacctatgagtgagaatatgcagtgtttggttttttgttcttgtgatattttactgagcatgatgatttccaatttcatccatgtccctacaaaggacatgaactcatcatttttttttttttttttttttttttttttttttttttttttgagacggagtctcgctctgtcgcccaggctggagtgcagtggcgggatctagggttactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagccgaactcatcattttttatggctgcatagtattccacggtgtatatgtgccacattttcttaatccagtctatcattgttggacatttgggttggttccaagtctttgctattgtgaatagtgccacaataaacatacttgtgcatgtgtctttatagcagcatgatctatagtcctttgggtatatacccagtaatgggatggctgggtcaaatggtatttctagttctagatccctgaggaatcaccacactgacttccacaagggttgaactagtttacagtcccaccaatggtgtaaaagtggtcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttgtcttgtaaatttgtttgagttcattgtagattctggatattagcccttcgtcagatgagtagattgcaaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctaatccatcttgaattaatttttgtataaggtgtaaggaagggatccagtttcagctttctacatatggctagccagttttcccagcaccatttattacatagggaatcctttccccattgcttgtttttctcaggtttgtcgaagatcagatagttgtagatgtgcggcgttatttctgagggctctgttctgttccattgatctatatctctgttttggtaccagtaccatgctgttttggttactgtagccttgtagtaggttgaagtcaggtagtgtaatgcctccagctttgttcttttggcttaggattgacttggcaatgtgggcttttttttggttccatatgaactttaaagtagttttttccaattctgtgaagaaagtcattggtagcttgatggggatggcattgaatctataaattaccttggtcaatatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttatacattgattttgtatcctgagacttttggcttatcagcttaaggagattttgggctgagacaatggggttttctagatatacaatcatgtcatctgcaaacagggacaatttgagttcctcttttcctaattgaataccctttatttccttctcctgcctaactgccctggccagaacttccaacactatgttgaataggagtggtgagagagggcatccctgtcttggcgagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataaccatgtggtttttgtctttggttctgtttatatgctggattacatttactgatttgcgtatattgaaccagtcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtgtcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattcgtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatccccttttatcattttttattgcatctatttgattcttctctcttttcttctttattagtcttgctagtggtcgatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtcaattttggatctttcctgctttcttttgtgggcatttcatgctataaatttccctctacacactgctttgaatgtgtcccagagattctggtatgttgtgtctttcttcttgttggtttcaaagaacatctttatttctgtcttcatttcgttatgtacccagtagtcattcaggagcacgttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctggaaaaaatgtatattctgttgatttggggtggagagttctgtagatgtctattaggtctgcttggtgcagagctgagttcaattcctggatatccttgttgactttctgtctcgttgatctgtctaatgttgacagtggggtgttaaagtctcccattattattgtgtgggagtctaaatctctttgtaggtcactcaggacttgctttatgaatctgggtgctcctgtattgggtgcatatatatttaggatagtttgctcttcttgttgaattgatccctttaccattatgtaatggccttctttgtctcttttgatctttgttggtttaaagtctgttttatcagagactaggattgcaacccttgtcttttttttgttttccatttacttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttgatattattatgtgtgaatttgatcctgtcattatgatgttcgctggttattttgctcgttagttgatgcagtttcttcctagcctcgatggtctttacaatttggcatgattttgcagtggctggtaccagttgttcctttccatgtttagtgcttccttcaggagctcttttagggcaggcctggttgtgacaaaatctctcagcatttgcttgtctgtaaaggattttatttctccttcacttatgaagtttagtttggctggatatgaagttctgggttgataattcttttctttaagaatgttgaatatcggcccccactctcttctggcttgtagagtttctgccaagagatccactgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatttgaatgttggcctgccttgctaggttggggaagttctgctggataatatcctgcggagtgttttccaacttggttccattctccccatcactttcaggtacaccaatcagatgtagatttggtcttttcacatagtcccatatttcttggaggctttgttcatttctttttattcttttttctctaaacttcccttctcgcttcatttcattcatttcatcttccatcactgataccctttctttcagttgatcgcatcggctcctgaggcttctgcattcctcacgtagttctcgagccttggctttcagctccatcagctcctttaagcacttctctgtattggttattctagttatacattcgtctaaatttttttcaaagtttttaacttctttgcctttgatttgaatttcttcctgtagctcggagtagtttgatcgtctgaagccttcttctctcaactcgtcaaagtcattctccatccagctttgttccgttgctggtgaggaactgcgttcctttggaagaggagaggcgctctgctttttagagtttccagtttttctgctctgttctttccccctctttgtggttttatcttcttttgttctttgatgatggtgatgtacagatgggtttttggtgtggatgtcctttctgtttgttagttttccttctaacagacaggaccctcagctgcaagtctgttggagtttgctagaggtccactccctaccctgtttgcccgggtaccagcagcggtagctgcacagcagcggattttcgtgaaccgtgaatgctgctgtctgatcgttcctctggaagttttttctcagaggagtacccggtcatgtgaggtgtcagtctgcccctactggggggtgcctcccagttaggctgctcaggggtcaggggtcagggacccacttgaggaggcagtctgcctgttctcagatctccagctgcgtgctaggagaaccactgctctcctcaaagctgtcagacagggacatttaagtctgcagaggttactgctgtctttttgtttgtctgtgccccgcccccagaggtggagcctacagaggcaggcaggcctccttgagctgtggtgggctccacccagttcgagcttcccggctgctttgtttacctaagcaagcctgggcaatggcgggcgcccctcccccagcctcactgccgccttgcagtttgatctcagactgctgtgctagcaatcagtgagactccgtgggcgtaggaccctccgagccaggtgcggcatataatctcctggtgcgccgttttttaagcccatcagaaaagcgcagtattcgggtgggagtgacccaattttccaggtgccgtctgtcacccctttctttgactaggaaagggaactccctgaccccttgcacttcccgagtgaggcaatgcctcgccctgcttcagctcgcacacggtgcgctgcacccactatcctgcacccactgtctggcactccctagtgagatgaacccggtacctcagatggaaatgcagaaatcacccatcttctgcgtcgctcacgctgggaactgtagaccggagctgttcctattcggccatctcggctcccacctgtttagtttttttgtttgtttgttcgtttgtttgagaccaaatctcactcttgtcatccaggctggagtgcgatggcagaatctcggctcattgcaacctccgcctcctgcgttcaagtgattctcctgcctcagcttcctaagtacctgggattacaggcgcacgccaccatgcctggctaattttttttctttttttgagatggagttttactcttgttgcccaggctggagtgcagtgctgcgacctcggcttactgcaacctctgcctcctgggttcaagcaattctcctgcctcagcctcctgagtagctgggattatagcacataccaccacacccagctaattttttgtatttttagtggagacagggtttcatcatgttggccaggctggtcttgaactcctgacctcaggtgatccacctgcctcagcctcccaaagtgcggggattacaggcgtgagccaccgcgtctggcctaatttttttgtattttagtagagatggggtttcgccatgttagccaggctggtgtcgaattcctgacctcaggtgtactgggattacaggcatgagccgctgcgcctggcctgagccaccacgcccagccagtggcttcttaaactcaagaaataaggtggtatttaaagatagactgaccctgtcaaaaagtggacaaaggatatgaacagatacttctcaaaaaaagacaattatgtggctaacaagcatatgaaaaaaagctcaacatcgctgattattaaagaaatgcaaatcaaaatgacagtgagatatcatcttacgccagtcagaatggtgattattaaaaaatcaagaaacaatagatgctggcaaggctgtggagaaacaggaacgcttttacactattggtgggagtataaattagttcaattaatgtggaagacagtgtagcaattccttaaggatcttgaaccagaaataccatttgatccagcaatcccattactggatatatacccaaaggaatataaatcattctactataaagacacatgcacacgtatgtttattgcagcactatttacaatagcaaagacaggaaccaacccaaatgcccatcaatgatagattgcataaggaaaatgtggtatatatacactatggaatactatgcagccataaaaaggaatgagatcatgtcctttgcagggacatagatgaagctggaagccatcatcctcagtaaactaacacagaaacggaaaaccaaacgctgcatgttcttataagtgggagttgaacaatgagaacacatggacacagggccgtgaacaacaaacaccagggccagtcgggggttgggggacgaggagagggagagcattaggacaaataactaatgcatgtggggcttaaaacctagatgacgggttgataggtgtagcaaaccaccatggcacacttatacctatgtaacaaatctacatattctgcacttgcatcctggaacttaaagtaaaatttaaatatatatatatttatatatgatatattttatatatcatatatataaatatatataatattaaatatatatatgatatataatatatatacactatatatgatatatataatatatatgatatataatatatatgatatatataatatatatgatatattatatatgatatatataatatatatgagatatatattatatatatgatatataaatatatatgagatatatattatatatatgatatataaatatatatgagatatatataaatctatatatatatcaggggtggaggaggatttctggctataggggctataggaacttgacaggattcttgctgaatgcaggctgaggtgatcaggtaatcacctggagaatggtggggaatgaggacttagatcatatatcaagagtgggtgattctggctaaaccaacttagcaggattcctgctaaagctgggctctggaggacatgccaaggatgaggcctactgaaaaaagagctcagaggaacctgtctagagtttggttaaggacagcgtctttttcagtgtatgtatatatacatacatacagatatataaataaaattaatttattcaaaaaatataatacagtttgtacaagtagtcagtggagttatttgcttctgtactaaatacctactgcaatgtgcctagctttgcatggatacttagatatgactcagagggtatactaacaatgataatataaattatcagggttttttttttaatgattcacttgagcttgaagtcaaaattctttgctactgaaataagtaggattttagacatttatacatacattttagagaggagttagaaaagggagaaggtctgtgttagaaatctatcttttcagcagttaatagaggtttccaaaattcaaatttagttgctaaattgtagttatttttgcccctctagcaaaaaaattaacttatttgttgattttaatatttttaacatgattatgtttttccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtaagtaaaagcacaacatagaaaaagtttcagtgttcaagcgtttatatctactgattgtctttccttacagtttagaatgtgttttcccagcagacttaactagtaattagtgtgcattttccttaaggttctgtctgattgtttccataagcagtgtctttttcagcagtttttaaaaaattattagtgatttcattcatgtccattatggatttatttccctctgtattcttttgaaaatctgattcatggctttaatgattagagagagtcacagcattgtgatacttcaaatgaaatacatcctcttaatttcatttctctgttgatgacagtaatagaaattgactctttcaaccaatggtgtgtcatctggacctctgtaatgcaccaaagatgttttgaaagagctagcatctctgtggataagtaaaatgttggatggtgtattaatctgttctgcagaggcaatcatgatagcatgtgctcataaagttttcatcttaagctctagtatctgactgtaaatgttaattaaaccacacagtgcttatgtgagagaaatataatttttattttccaaggtcatcagctgacatgaactcctcccagacatttacaaattcagttccaaggaataatcacaaagttgaattttaatatgctttcttaaatccatacttataagtgactagtatcttaaagaataaaagccacttactcttttatctctctggattttacttttcactattgaggcaaacgagcacttcagcttctttgggagttgtttcttattctcgtttctttgattcacatgggtttcttctctgagtgatggtggaatgtgctccaagtaaggtagaaatctctttgtgagtgcttgagagtaatccagggcttcaacaagtataacaaagacaccaaagttcaatgtcacacaggtttgatgtcagtttcctgccttgccacttactggttctttggtataggaaagaatcttagtttaccttctctgtaagatggtcataacatttgtgccttcagattgttataaaaatgaaatgagataatatatgtataatgcctggtacataggaggttagacacagaatttactagcgtactaaaagttgaagctagttttatcgtaaacattagcagtatttgtgatctgggaatgcatcctctggttttaaactttggttcattttttttttaaggtcctccttcaccaaccaaaactgccaaaatggtgagtatacactggtcctcaaatcttttccccaacacactgagagagatgccacattcccctctgtaagaggagctcactgtggtgatgattatcgactgggagaagttaggaggcatgctgcccttggcttgtatttattagaaactagggaagcgtttgaaaaagccccctagtgaggagatgtgctccactggttaagtattgcaactggaggattactaaaggcctattgtaccaataatcctgttctctaagttataaaatgtgaacacattaaagaaccaacctagaggtctttttacttttgtgtttcagagaaacaaggtaggaaggacctaaatgttaagacagatgataaactattacatcgtcttgcccctgcctgaagagaagacgtactagttcacataattttgtggggactataaatatgcatgcacctttagataatcttcttacttttaagactaaattaggcttatttttttattatttattttttatttatttatttattttttgagacggagtcttgctctgtcgcccaggctggagtgcagtggcgctatctcggctcactgcaacctccgcctccggggttcaagcgattctcctgcctcagcctcccaagtagctgggactacaggtgcacgccaccacacccagctaatttttttgtatttttagtagagacagggtttcaccatgttggctaggatggtctcaatctcttgacctcatgatctgcccgcctcggcctcccaaagtgctgggattacaggcatgatacaccacgtccggctgactaaacaagactttctagagtaattgtggccttctatgctaaatttgcttgttgtcaaagtgaaagacctgaaacagtgtcttctttggcattcttctaaataatcacgtagcctgtttaaggacctgtgcagagaataagaactttaaaaaggagtgcatcaaatgctgctgttgtggaagaaactctacaaggtgcacatttgtagctatttaaatatccacaatgttttggatataaagacaattttatttaaaattctaatttagttctagtttgctcctttggagtcttttatctcaaaatcaaaagatggccttccataaccataaactatagacaattatattaaatgaattagttctttctagcccaccaagtaggaatcctctgcaaatttgctgttttatagattaaaaagaatccctcagcttctggccttttttttttttttttttttgagacagagtctcactccatcacccaggctggaatgcagtggtgtgattttggctcactgcagcctctgccgcctaggttcaagcaattcttgtgccttagcctcccagtagctggaattacaggtgcacgccaccacacgcagctaatttttatatttttggtagagatggagtttcactacattggctaggctggtctcaaattcctgacctcaggtgatctgcccacctcggcctcccaaagtgctgggattacaggcatgagccactgcgcccggccagcttctgcccttttcattgactgcttatactacttgggtccagtgtgaacagaaattgtttttgtccattcagttcaaattgcactgtattctacatttctctggttcctctagtaatcatttttaactcctgtgccaccatatttatttcataatggatgccactgcagtcgcagtggccctaatgctttataattgatggaagggtctgatgaactttaaccgcctctgacagaatgctaagatgtatggggaagggtaggagactactgttagcttctctgccttctcattgggtctgggtgattgaagggtcccctctagcacgacactttgtagtggctgacccctgattactccctgacagactggtgcccctgcattctagtcattgttaatgatcacaaacatccataatctccctctcctaacaataatccaggaaaacgagctggtctcaaaaccatatttcttaggccatttattggatttcattgttaacattttattaaataagtcattttgcttggctgttatcttgggaaagttctagctgaataggaaaaatatcaaaatatgctactatgctttcccttatctaattgtcttgcatggtacattttctcttaatatatgtgaattggccagacagggttttcacagtgccatctttataacctaaattagagttaacctctcctgttttcttagaaagagtattatcttaaacatcttccttagaaattaaactcagtgaatgggaggtgggccgtgctaagaattttatgaagatattctctgaatctccctcttactttacttagaagtgctgccttgtattgtatttctatttatcttcatctcaaagtcaatttgtgtcttggtggtggagaaaagggcaaaattgtttaaacataggactaactaaggctcttcagttgatattactataaacttttttctaatttaagttaaatatgtttcaaccaaatacacattgctatgaaaatgaattcctgtaactgtaaatctgctgtgtctttgatcctgccacctatacaactataatcagttgacatatccatttcagatatcagttttatgaattaatcaaccatctgctttttaaaaaatactaagtaaggctcttttccatttcagaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaacgtaagtagttgtggaatatttcaggagagcatataacaagataaatttggatttattttagactaggaccttcccatctttcagaagcatattgaaaagttattccttcattaccattttaatagaactctggacttcttccatgtatattcgacattcacacattcatttttttcaaaatcatgctttaagtgctagttatctaccagatgccatactaggtaaccagaatacagagataaataggttacataggacctgcacccaaaaatattattagaactaaatggaaaaagacaaatatgtaatcaaatagtatacaaataagtacacataataagcctaacaggtacagtgatagaaagatgaaatggataaattgggatccaaagaaggaatattcagttttatcagtgtgggcagtaggaagtgtcaggaaaagcttcatactggaagcaaagctttaactaagtcatcagggatgaaaaagtgtctttgaggaagataaaagggaaagatagaaggaatagcacatgcacactggccttgcatgacttgggctctgcaagtagttcactttcgctgggtgcaattggcaaggaaagtcacagaggagagcaggaacagattgaggaaggccaatgatgcccttccaagggagctggagttggtcatataaataacagagaaccacagaatgcctttaactataaggaaggcatagttttgtgttttagaaaggtttttctggcaggagtatgaaggatgaatcagaggtgtatgcaatttgagggagggtgtgcaatttgaagaagaaactaaagagttgactccttacaggagtccagctgagagataaaaagagagactgcataaggcagaaattcatgcatgttcctactaattcacttactaatgataaatcttttccaaagtaaaattgcagatttgagtaggtataattttttaaaatttatttgttcttagaaagagatgtaaatctaccttggaaaagatatgtacaagtggaatatatgtatagttgacttaatgcttatttaactagttgcagaagtacatcttgataatcccaagccatattcagaaagatgaaaaccagttgtacgcccagcaaagcaataatttaaattagcataacaatgtagaatccctttcttcatactttccattcatagcctgatacattattaatactggtataaactctgcagtcccatcaggcttcacccataaaataagtgagttgaactgatgactctttttttttttttcccctgagacagagtcttgctctgtcacccggagctggagtgcagtggcacaatctcagctcactgaaacctctgcctcctaggttcaagcaattctcctgcctcagcctcctgagtagctggcactacaggcgtatgccaccatgactggctaagttttgcatttttagtagagacggggtttcaccatgttagtcaagctggtctcaaactcctgacctcgtgatccgcccacctcggcctcccaaagtggactcttttaatctctaaagttctacaattttaataggaagtatatatcaaaagatactgcttctatagaatattatcaggaatttactaatctcactttttacatagttccctgacatgtttatttcttctctctttacagtaaatacttcttacctataaataacattaatattttcccaaaggaaaaattttagtcatgaaatagatttttgtgacttaatattctttttttttttttttgagatggagtcttgctctgttgcccaggctggaatgcagtggcacgatctcagttcactgcaacctctgcctcccaggttcaagcaatcctcctgcttaatattctaaggaatacaacctaccctttgagggtaggacagtatgagttaggagattagaccctggaaatcaacctggatttaaatcttagcttcaccacttgctatgtgacaatggccaacttacttacaccctcagttttcccacctagaaaatggggctaataataaatgttagctcttaattattttcctttaaaatgctatcattttgcaaaactaggctaggtaagtagttcatatggaatacttttctgagagaaaggtattagcttgagagcaggaataaggtattttacaggcactctatacagcagtgcctgtacagatttaatgtaccttacccaagtgttaacttaggtcatttgcacctgtcaaatatcaaactcaagtttgatcattctgaattcaacattgttatattgattggacagcattagaagttaatggcagtgtaatactgagtatatggaagtgagagtaaatgtttctaaacagtcttcatacagttttgtttagagctcaaaacgaggatttatagttgaattgtgtgtgtgtgttacactcttgtgcaaattttccatattaaaaagttctgagattatagtttattgagttactctataatatcctactaaatactgaactttgttttgttttaatccttttaaaataaatcatagtatttatattttctgattttcctcagcaccaaacaccaaagatttggatgtttttcttcgaaaacaagagtcagggtttggcttcagggtgctaggaggagatggacctgaccagtctgtaagtgtcacttctttggaacatggctgtttcctgttcaaacgttttgagtggtgatttggtggattatggtgtgttttaagtttttttttctctgacagtttcattaatatgaagaataactgcatttccattattatcatagtccctcagttattgtggtgtagctgaggctaaaaactgtgggtaaaaactgaatatgtcagctgcaaattagacagtgattaatttatttacttctctgtgtgaataactacataaagcttattttaagtttatattttcctttgccctcattaaacagagtctaagacattttccttctctaagaagcctataatcccatgtcctctttcccactattactctatcttctggatgctccataaatggttggcatgagcctgtgcatattgtttcacctcgtcttattaataggttggcattttcatgctcagtactttgcatgtcatttcatctgttacctttgaaactagaggaatataaaataattaatatttttgtccagaggcataagggttatatttgcaaagcatttgaagtctaggattttgtttacacatgattctcacataaacttgttttagagaacaaatgtagtgggttttgtttctaagttttgctcttggtttgaataacaaagaagtaatgtgttctgtagcatttttaagaacatatttgcattttattttatataatatcaatatattatatatcaaaaaatatggttggaagttaggtgaagaacaataatctttaaaaattacaggcttcttatttctgaatagaacatttgatttatgtagtataaatttgttctaattggtcatattggttacagttacaacagtcattggagacacataaagcttaaggcaggttgccctatgtagaacaaatactagatactttaattgttcttggtatttgtatttttgttttattgcttcctattttgttgatactcataatgttcacttagacattttaagaatttgtctcaaacaacttagaagaaacctttcttttctcttaaatgtcagattttagcagctctgaaactagcctaaacattcaggattgcctaattacaggattctaatgctggtgagcaaaatgaaccagatttgttcacctagatgcaagtgaagcttcaggccactctgttcccgctgagatttagaaacaagaaatgtctctgtgctgtgtatattgaacttgtaccgttagtcatatgtgatgggagtactgttgagaatgatcccagttgctgtgaacagtatgtagaaaatcttgcctgatgacattgaacagacttttaatagctactctgcagatttatattttctgagtttagtgttttgtttcattgtaatgatagggataatggttgtgctttttgagttatcgaacaactttgtattttctattttctttgtacacagccctgaggatctataagggattacataatacaatgtggttatttgaagtgccattttggagaatgggcactttctcagataatacctttctaaaatataactgttttcatagttgaactgcaaaaatctgttggtttgcacaatgctaagttaggaattccttaactcttcagctaaactttacactgtggaccaaactgtactttgttatcttatcagatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggaggtgtgtgaacttgttcctgctctgaaaagttaaaaaagaaacaaagatactagtctacttcctgtgtagttttgcaggttattttattacattcagtagtatctaagataacccatttggtgtgatccagggcctcactgtggaaggctatgcaaacacaaaaggattcagaaataatactactataaaaaaataaattttgggcttctatattaagattattttcatatattgatgcattttgcaaatgtattataggtgggagtattgatttaaatccggttttgttttgttttgttgagttgaggtagagtctcactctgtcacccaggctagagtgcagtggtatgagctcagctcactgcaacctccacctcttgggttcaagcgattctcctgcctcagcctcctgagtagctgggattacaggcacacaccaccacacggctaatttttgtatttttagtagagacggggtttcaccacattggccaggctggtctcgaactcttgacctcaagtgatccacctgtctcagactcccaaagtgctggaattacaggcgtgagccactgtgcccagcctaaatttgttttgtttttttttaaataacaaatacaaaattatttagtcataccaagatatcccactagctgaatatacaaagatttttggatcccagtgaaatctgagctactaaaggaaagtaggatgtttctacttgagaagttttagtataatttaacatttattgagtgcttactatgtcctagatgcatggattattttatttaatcttcacaacactatgaggtcattatctagttctatgattactcagagaaaggttgagaaacaaataactggtaagaggtagggcctggattaaaagttgcagtttaattcagagatcagggtttaaaccatagcattaggatatgaatatctcttatagtttctcgccagtagctttatgaataattaaatagaaattcttataagtgaattctttccactttaaaattaaaaaaatacaactctgtagcacaagaatataagcctcatgaaggtatgaatttttatttgtgtagttatctgctgtaagctcggcacctaaaagagtgcctgtctggtacaaagtggacattaataaatgttgttaattggatgaatatttacatcactcttaaaaatgaggcactgtattttttattgcaacattcaaagtaaaggcctgcctcctttggtaaataccaggcatttagaatgcatatagattgtaatgcagtactgcctcaatttggttgtgttggaggccaaatgtaactacttacagtaaaattgtgatgttatacaacctacgctcttccctggaaagaatcatgaagaagtttcatagtagtttggtattattggagacattttagctaatacattctaactatgcattttgaaaaaaaaaaagaaaaaaacatattcttaaaaccatgtgaattttcagccagaaagagaccttataaatatggacatgactgcagtgtgttgtggttattattaacgatggtttgtaccaaattatggcaaaaaatatgccctttttaaaaaatcagttaggactttgtgtcattctcaagttctgatgtcatccttgaagagcagaaaaaggtgtaggttaattggccatttgtcaggaatttcatatgaccctgtctatgcccagaagtgtttgctattcatgtggacagcttgttatgtgtcccagcaagttgaggggtggaggttggggaggttgaaggctgagaactgctaatgatgaactcatcttatatcatcactcaggaaactgcagttgcaaaacacatcatataagacaaatcctgtacaggtagcaaactgttataatggggcagcatttctgccctgatgctttaacctctaagacagacatcaatgaatatcagtcactgagctaaattatatttataattgattttaaaaggaagttcatgtgtcattcctcattatgtgtttcattaaaattattggtccatgttataaaacttgatggaactaaaacagttttaggaagaatttttttactatcaaatctcacagaaactttgaaaagcttcctttaaaatgagatcatgaggtcaggagttcgagaccagcctggccaatatggtgaaaccccatctcttctaaaaatacaaaaattagccgggcatggtggtgggcacctgtaatcccagctactcaggaggctgaggcaggagaatggcgtgaacccaggaagcagaggttgcaatgagccgagatcgcgccactgcactccagcctaggtgacagagcaagacgccatctcggggaaaaaaaaaaatgagataacatgagattgtatgtatttttcagtaatccactctgagtatttgggaagtcggatggactgctgttgcctacatctgcactcagattatacccgaagctcacatgtggggctgcttttctattctttatgttattagaaactgaatttttctgtgagaggcttagcataaaaacactttagtcaccagaaattatgatgttccagacatatcaaaactgatcatgtttattacagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggaggtaagggctattgtatcttattgtctctccctgcaagtccagttttctgaggctcccactggagtttatgaaataattaggagctatgtataaaatgccttaggtacttatctttttaagaatggtgaatactttccttattttcaaaattaggtaatttgaaccgaaccttccaggcttcaagtttatctattatctcacattctataaaatatttaataagtctcagtagctccatttgcctcaaggttatactgaagacagtatgtcatagatatggatttaatgaaaggtataatgctgacttttaagaaaatggggacataggttttgaaaattaggataaatcgtgtatgtagaaaatagagactagaagcaattgagaagaagcaaagcagattaacagaaaaatcttgacccaaatatgtcgtagatattttatgttattatttaataataattgccatagtccagctataaattacccttgttgaatgataagaggcataccttttataaatgtttcattgaaaggtaaaaattttgtcaacaattggaaaatggatctaaatatcttgaaccaagtttaacagaatattctaatccagaagatgaatgtatttatatcagttccatgatcaaaggaggaattacatctgatatattcagggctgttacgattcagcaaatgaaatatttgtcttgatatttctataaaataataatttttaatataattataaaatccagttgaatatgagaaccagctccaagtcaaataataaaaatctttgaccacatgaaaatgtgcccttgcctttacaagtcagtttgattatgttttgaatagtgagatccttttagaccaagtggttgctaaaaccttagtttaaaaaaaagaaaacacttttaggaaagtgttgtgagccaaatcagtttgcaaaaatcttgctaaaattaatggaaatgtataagggaaaaagagtccatgacatggatgagttattgctatagtattaggtcactgctcactgatgctagtttccattttcccaaagcagttgccatggaaacacttggaactggaactgtcactgatgctgtgaggatgataatatggcgtgtgtcagaaaaatgaaaggaaagcagcttttaggtggttttcatgttgtatcattggaatcagtatttccaaaaacagataaccatttaggataatgatattgtcattctcgtaacatacaataacaccaggcattcagattaactaaaacagtgaaagtattactctagtagatagatgctaaccactttctatattgaagatattccctttctagcactacagaaatttggggaaagtctagtgttcactataaaactaagctatatagaggaattcagtaaaataagtttcattgcttaaatatatttaagcatatttttacatttatttatatttaacatttatgttatattaaattttaatatattaagtatttttatttgtatatattggtaaatttttaaaaatttaaaaatctttaagtagttttatatttccttgtttcaatcattttttactattgtgatggttttacctatggagatacttcatctctttaagatagtgtcattaagtgttgtgttttgtaatccaacaaacttggattcaagtcctgcttatgtcttttaatagctgtctgatcttgggcaaattactttccctccaagagctccagtttcttccacaaaatgaggatgatagagacactccctgtctcatgaatgtgaggattaaaggagacagggtatgtgaagcccttagccaaggccttcagtaaatgttagctgctgttgcttgttgtaacttctgctgccattgttatcatcatcattatttagaaaattgtcaccgtctcttaacttttcttttaaaaaaaaacttttaaaagttcatcaatacttaataatgagataggaaagaaagcccaattaaaatgtaagattgaggcagcagctaacatgtggcaggagatgagtatttgcagctcattaattatcaggctgaatggtaaattaggctcaggttgttgatgaattttatgtaaagtacttgagattttcagtcatggtgtaaaaccagaattgataatttcactgaaatgctagttaataatctcataaaatgttgaggcctgagagtattcttgttagaattttatttttcacatatagacagaaaaagggtcctggggaaagctccaatgaggagttttcacttacagagactgaacacttgctgcaaactgtatgacagagaaggtttggttcagaaaggagttagcacaggtggaaaggcaggaaacctgtctcagaatagatcagtattttctttttcttttttttttttttgagacagtcttactctgttgcccaggctggagtggagtggtgtgatctcggttcactgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccaacctcaggcaatccacccaccttggcctcccaaagtgctgggattacagacatgagccaccgtgcccagccagatcattctttatggacctcatctcaggtattttctgatgacgtatgtctcaagaagagttcctagtagcatctgtggtaccagttatggaattctgagtttctctactgttgactttttcaaagatcagggatccaggtctagcatcctcacaatttgtctaagtgctgaatgaatggagtacttagaaaaggcctctatttaagattaagaagactcggctagtttttgctttactagtacttcagagcttttagtgttattccttcttatcatgtagttttcagttctggttgcaaaggatttctttgaaaagggaacatttccagttactgttctttgttttcctgaaaagaaatgttttaagagcactaaagtgatctcaggatctagacaagccaggctatgagacagatttaggccaaagatgaatgaagatggataagttggctttatggcaaatgcctgtagactttgtgtatcaacaaaaacaaggcaggactgaaggcttttccctagctatgtgaactctaaggggttaccttgaacagtttcccagtccgtttagaaaatgttcagaagctacctttctactggtctgtttgctatttttaactgttccggtgacactgctataaatactaagacagtaacaatctgactgcttttaccttccctcacccagacaaccagccctttaggaagttgtataccaccatgcaccaattctttttaccacattgctcgcagactgagaaaggggaccactaagatttcagagattaattctatttaatgctttcccaagtctgaacaaactccttttagtgagccaaggaactgaatgattttcttctcagagtatctagaaagaacactatgtttgagtaaatcttttgtaaggagaataactgagatattgatttagaaggtcaccacagggccaccgtatgacctgccgtatgtttctggtgtgccacctgttgtagaattagtgaatcaactcataatgcctgatatgacatggccctttctgcactggcatttctctaattacgttgtttgtaaggaaaatagaataataagtgcttgacataattcagagctaaaaggcacttccttccaacattgacttactctattttaagataaaatctgccactgtgtattcctagaagagccagggcactgtctgtagggaaataaatcatcatcaagaataacttttctactccaaatgaaggtctatttaaatgtcccttacatactcctagatatgattcagaaatactagtaaggagcaggttttactatggaaattaaacatcattcacagtgccattcaaaaatatgaattatccctattcaaatcagtcagtagtcagcaggagcccacatacctgataagtttaaagtttactgacctaggctaggaaattctcagagaacatagaaggaacatttgtttcctaatacaaatgctgcctgttgcacggtggaaaatattttgtttgacaagatttcctgaatatctgagaactcatttcaagctataataatagcagagtatcttaatagttagtccaggaaggctcttagcattataagctagagatacagtagagctacacagagcatctttgcaattgtattagactcagctttgtgtatttggtttagaatttgatccatgagtcaagtagtcttaacagttaacatttaatgttccaattccactcagcttttcaaattttaaaaagagccaaaggcataaataagaggaattaatttacatgtggaattaagtatgattcattttaattgtcagtcatttcactgtacctgaatttctgaccaataactaccgagtgctaaacctgagtttgacctgcatttatttacaaggttccttatgggagcaagtgtccctttaacagaagcaaagataatcttatcgtagcagtttttaaaatagctaaaaacttgttgcagcttaaatggccaacaataaacaatgagacatctgatcagtcaggtggtatcagtgagattagtagctcttaaacagaacaattacgatgagaatgtaaaaattagaaaaaggtttctggtaggtagaaaatagcaaagaggtttatatgctatgattacaactgtgtaaagagtatttatgcatgtgggcaaaagtgagaagtatgaaaatagttccgtttggatgcgatgatgacgtgtggtacttttctgttatgtttttaaataattttctttgatgttatgttgaattttaaatgacgttgattataaatctaacactagcagaaatcttaaataattgaaaaacctggggttttttttcccatagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaaggtaaggagccagtagacgcgcctgccccaagctgatctgagaggcacaaagcctgtgtgaggcagtggcctcctccagcactgccagaatcactgcggggatataactgtgtatgcacgctggagtcttattcttccccttttcaatttaatgaacttaaaaaacaacttattataaagttgtcagcagctcaagaaaaataatccagctagtgagtgtggaccgtttatttatgtgctagagaagcaagcacccagaagtgaaagagactggtagtacttttcagatcttattttcttaaaataatgtcttaagtcttcgcttaagtgagagaaaatcctttaaacagttcaaagaaagtcactgttgatatcaagtcttttatgtcaggcccatgccacagtgtgcctttccttggggacagggctttgttctgggcagccgctttgtaaacagggtaaaggagtgcgtgggaatggctagtaagtggggcataaaacacatactggcagccgtggagtctcccaaacatgtttaatgtcttgccttgctgtaaagctgccttttgatcattaagaatttctaattaggaaccatctttagccagtccatattctttgtgaattacaacataaccactatgtaatgctctcatttttcctgattttgcaaaactaacaaggagaagccaaaaacagaattatgaagggtcagtctttgatgttaaaattcctcatactataatgtgtattcatgttccattttctcccatgaccctctaatctagttggtttccaagtcttttatacttcctggttctaccttttgtttctgttcctaccacaccactctcatcatttatttctaaggtattacataaatctgttcaagatgctataggggttatttctgcatggacatgaattgacttcactgctcccttaggccctgtcgaattctgggcaggattccaagatgctgtgacatccctgcctttgttctttcccttctccattctgttcctatactcttctcagactctgctgattcttttctaaaataatcccttgtagaagctccactgcttccccactctctgcccagaaagtgttctgtgattttgctctcagccttttaaatgtacttctcagtattctctccacaccctctctaagctgggcctcactggcctctatgtacatggccttcccccgcaaccgcaactcccatagcacctcctatctctgcacttcactggacatcattcttacataaccatatccctatttaaatggtctgctctttgtaaacaaaaaacatattggttgactatgatactagatgctcagcattttttttttttttttgagacagggtctcactctgttgcccaggctggagtgcagtggcacagtcctggctcgctgcagtctcaacctcccgggctcaagtgatcctctgacctcagcgtcctgagtagctaggactacataatttttaattttttttttttttttttttgagataggggtctcactgtgttgcgtagtctggtctcgaactcctgggctcaagcgatcttcctgcctcagcctcccacagtgctagtattacaggcgtgagccaccatgcctggccagcaaatattttttgaatgaaggaatgagtaaacgaatgagtgaacaaagtaaaagttaggagatgttagttctgagggcttctgtcccattacctaagcagaggctatttaaacccaataaaagaagtaaggcttttgacaaaggccacagatacctattagctagttacatgacaaaaaaactacataatatttctaatcttcacttttttaactgtagaactggagtagtaatatctatttcagtatcatcatcaggggttaaaggtgaaaatatacataaactgcataaataccctagggtgctcatctaatatcattattttacctacatgactggctccctcattcaggtctctgtttaaatctcacttcccaaggaaataataatagtatttaataagtgtgtactatgtgacaggcactgtcctaaatgcttgacatatattaactaatacaataatcctaggcaggcactatggttttccaattcttgtagatgaggaaactgagtcacagagcagttagatgaattgcctgtggttaaaaaatgttctaaatgcttactctcaatatctatgtatctcgtctatgaaccacactttgggtagccttgggatagattgttaggaaaaaaaactacttctttctccagtaacttttcccccaaaattactgtttaatgttgatggtattttctccaagagattatccaagattgttcataatttttcttagaataaaagttccctttcacattctggcccaaacacttgtggacagacacttaagatttcctgtgtaacgtcagtttgtgtgcagagaaaagagaagggtggagggaagctccctagaagatatatacttaaagtatatttcatatgcagccacagcctcttaaaatacagtcacattttatatgttaaatcacatttcactgatcacacactattttattatgctctaggttttttttaaactatgaaaacatccagaatctcttatttttcttaggaaaaaacagaaaatcttccttctgtccataaagatctcattcatggagtttgtaagccttccaggttctcataaaattcagtataaaatctatcaactgcattaatgagtcaaatgaatatttataactctaaagctattttcagaaaccacacattcagatcaataccttagggcagcagagcttcccatctgatacttctccccttctctccatcagccattccccattgacaggtaaaagacagttacctagaaaatgaacaactcttggtccctccatccttttttccccctttgctagatgctgtttaatatttgtgcctatgttgccaaggatatggtaaggcaagtgtcatatttcataaaagacttccaaactgtagccaggacttgagactgttctctatcatatggcattccccacaacactaccgcctcttcctctgccatggtatcttgtttttaaatatggaacataaatttactatatctggtagttcctgcttactgtaaaaaaaaacttaaattatataatttttcaaaattaatttcaaattttttgtcaggccttgttaattttaagagtgaacatgacttaccaaaggctaccaagcactcctgttggaattgattctggtagtgttgcaatacttttgttttgttttgttttcagttgatttatctgtttattcccatttgtctccattttccattctcatttctctcactgctcccattggcaagcattctagtatgttttatgtactgcattttatttgtacatcttttaaaatacattttttgttgtgtgttggcatttatttttgagttacgtaaatgttatggattttacactgggtttttctcagaaccatgttgttgttgttttcttttaatgccattttactgttctaagatccaatccagtattcctcttgacatttagctgttgtcttttttttctttttaattgggatagacttcatatactataaaattaatcattctaaaatatacaatttggcctggcgccgtggctcatgcctgtaatcccagcactttgggaggccaaggcaggcggatcaactgaggtcgggagttcaagaccaacctgaccaacatggagaaaccccacctctactaaaaatacaaaattagccaggcgtgatggcatgtgcctgtaatcccagctactcgggaggctgaggcaggagaatcacttgaacccgggaggcagaggttgctgtgagctgagattgcgccattgcactccagcctgggcaacaagagtgaaactccatctcaaaaacagaaatatatatatatatatatatatgcatttcagtggtttttagtatattcacagggttttgcaatcattaccactagttccacattttattgctccaaaaagaaacttcatacccattagaaatcacttcccattctctcgaaacccccatccctaggcaaccacttatccactttctgtctctgtggatttgctgggtatttcatataaatagaatcatacaatatgtggccttttgtgtctggcttctttcatctggcaaaatgttttcaaggtacgtcctagttgtagcatgcatcagtactgcattcctttttatgactaatgaacaatatttcattatgcatacatatatttttcttacctattaatcatttgatagacatttcagttgtttctactactgtgaataatgccactacaaatgctgttttataggtttttgtgttgttttatgatttcatttttcttggtcgtatacctaggagtggaattgttgggtcgcatggtaactatgtttagctttttgaagaacttcaaaactgttttccacagcagctgcacccttttatattcccaccagcaatgtatgaggcttccatttccccatatccttgccaacacttattttctgtttcaggggtttgttttctagccattctagtgggtatgaaatggtatttcattgtggttttgattggcattttgctgatgagtaatgatgttgaacatctttttcatgtgcttattgactatttgtaaatcttctttacatagagaaatgtctatttaaatcctttgccatttataactcagttatttgtcttttttattgttgaattgttttctgaatactagacctttatcagatacatggtttgcaagtatttttctcccattctccatttgtctttttactttcttgatactatcctttgatgcacaaagttttaatgctgaagaaatctaattcctctatttacaggggcggtgcttgtgctttggtatcatagcatcatatgcttttaagatttatctgcattgctgggtgaccataattgattgcttttaactgcttgaccgttttccatgagtatttaccacaaataacctgtccacttccctatagacagtcacattgcctacaacactacagtattacaaacaattctataatacacatcttcacatatctatgttacaaaacagtgtgagaagccaggcattggtggcacatgcttgtagtcccagctacacaggaggatcacttcagcccagaagtttaggccagcctagataacatagcaagaccttatctcttaaaaaaataaaaaaacagtgtgagaatttctgggagtgaaattacttgatcagagggtatacatgtatttgatttaatattgtcagattgttgcatccatctactcccaccagcaaaacattgaggattctgatactgtacttccccaccagtactttgtattatcagcttttgaatttgctagcctaaagcatgaaggtgttgtcttattatttaatttgcatttctctgattgcccatgaatttcagcatctcttcatatgcttgagtttttttcttgtgggatttctgtgttgttgatatttattggatactcatgaattatatggacttcagtagtacagttttgttttagagactataaatatctatctttttctgccatctgtatgttctttgaccatggtaccctttattatacagaaattcttaatttagatgtaatcaaatttgtcactttttacctacagcttaaactcttgaggttttatttaagataagtcattttttccccacatcacagagatttttcttttatatgatctaataccagatttgtaattttgatttttgtacttaggtctttaatccatctggagcctacctttgtatgtagttttaggagggatgtagttttattttttattcttaagatgagccagatttcccaacaccagctattagacagcacttctttgccttatttatttgtgatgccatctctcctatatatcaacttcccctttaaacatgagtctccaagtcctctattctgttctattagtttatttgttcttgggctgatgatatgtgtgtgtgtgtattttttatttttttatctgtaagtttgtgatacatcctaatatatctgcttattagggaaaacctatctgtctccctgtttctcaaaattgactacatattcatggaacttttctatataaaattttagaacaaattattaagctcctccaaaaaaaatcaaagtgcagttttttggggatatattgtgtatacgcgtatataaatatatatgtgtgtatgtatatatattttgggggtggagaatatctttacatattaagtcatctcaccaaagatcatggactgtatttccaattattcagctcatcttttatgtcctttaatagagttttagagttctagtatgttctctcatagggttcttatttactcttggtaaggtgagtctcaatagattataatgtttattgctgtagtttaactgtggattttgtttttatcttttgaaaatacactttcttttaagtgtattattataggcataccttggagatactgcaggttcagttataggccactgccattaggtagtgaatattgcaataaagtgaatcacatgaactttttggttttctagtgcatatagaagttatatttacactatactgtagtctcttaagtgtgcaatagcagtatgtcttaaaaaacaatatacataccttaatgaaagtatactttattgctaagaaatgctaatgatcatctgggcctttagtaagtcttaatctttatgctgatggagggtcttgcctcgatgttgatggttgctgactgatttgggtggtagttactgaaggttgaggtggctgtagcaatttcttaaaataagacaataaagtctgccacattgactctttctttcaccaaagatctctctgtagcatgtgatgctgtttgatagcattttacccacagtaaaacttctttcaaaattggactttgtcctctcaaactttgcctctactttatcaactaaggttatgtactattctaaatcctttgtggtcatttcaacagtgttcacagcatcttcaccaggagtagattccatctcaagaagccacttctttgctcatccgtaggaagcaaatcctcacctgttcaagttttgtcatgagattacagcaattcagtcccaacttcaggctctacttctaattctgttccttgctgtttctaccacatctgcagttacttcctccactgaagtcttgaacctctcaaagtcatccatgggaactagaatcaaattattccaaattcccgttaatgttgatatttttgacctcttccccatgaatcacgaatgttcttaatgtcgtctagaaacctttccaggttttcagtttgctttgcctagacccgtagaaaaatcactatctgtggcagctatagacttaccaaatatatttcttaaaatactaagacttgaaagtcaaaattactccttgatccatgggctacagaatggatgttgtattggaactcatgaaaacaacatttatctccttgtatttctccatcagagctcttgagtgactaggtgctttgtcagtaagcagtaatattttgaaaggaatctttttttctgagcagtaggtctcaacagtgggattaaattattcagtaaatcatgctgtaaacagatgtgctgtcatccaggctttattgttccatttttagagcataggcagagtagatttagcataattcttaagggccctaagatttttggagtgtaaatgagcacatgaatttaccagctgcattagcccctagcaagagagtcagctgcctttgaagctttgaagccaggcattgacttctcctttctagctatgaaagtcctagatggcatcttcttctaataagaggctgttttgtctaccttgaaaatctgttgtttagtgtagccaccttcaccaatgatattagttgaatcttctggaaaagttgctgcagcttctgtatcagcacttgctgcttcaccttgcagttttatattatagagatgacttctttccttaaacctcatgaaccagcttcttctagcttcacacttttcttctgcagcttcctcagctctcagaatggaagaaagttagggccttgctctggattaggctttggcttatggaaatactgtggctggtttgatcttctatccagaccactaaaactttctccatatccagcaataaggctgtttcattttcttgtcactcatttgttcactggagtaatatttacaattttcttcaagaacttttcttttgcattcacaacttggctaactggtacaagaggtctagctttcagcctgtctcaggtctcaacaagccttcctcactaagcttaatcaagtctagcttttgacgtaaagtgagagatatgcaactctttctttcacttgaatacatagaggtcattgtagggttattaattggcatgatcaatattgtgcatctcagggaatagaggggcctgaggagagggagaaagatggggaaaggctagttgatggagccagcacacacatatttatcgattatgtttgccattttatatgggtgtgatttgtggcacccaaaaacaattagagacaagtaacttgaaattgacatacccagtaagcaaaggtggaagacctgggaatttccagtgggtacaagaatataaatatcaaagatcactgaccacagatcaccataacagatataataataatgaaaaagttagaaattttggaagaattaccaaaatgtgacacagagacatgaaagtgagcacatgctgttggaaaaatggcactaatagactcgcccaatgcagggttgccataaaccttcaatttataaaaaatgcaataaaatgaagtgtactaaaataaggcatacctatacttacagacagaaagcccagcaaaaatgtaattctcatcgaaggagagatatacttaacccattgctttactattttaagaattttcaaataaaattcagagagaagataggcctgtttgacattatggaataaatatttgactttgtgaagtaaaatagcttataacagaaaaaaaatggagaagccatgtagcacgggttgaaggactaaaaatgaaaagaatcccagtgataggaagttttacttaaatttgatgaagacaacaaaacaacaaaaaacatgtaacttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggccaaaaacatgtaactttaaaagtaagcaccaatttgtggtacattttgcctggaactgaaatgtctcatctggaatggaaggtagaggaaaacttgaaattgatcagattacttctattgtcctgctctgatgttatacactcattacaatagccaagctagtaacgccgataaattatctctcttgaccacatgcaaaggtacaagtatctcccagtcatctcattggcaaatggaattttccccatcattttccatctccttaatagtaaccatgaatttacagcgaccgaagacaatcgaactctatactgggcagtaaagtttagagacaggtaacttgaaattgacatacccaggaagcaaatgtggaagaacttatggaaatttctagtgagtacaggaatatcgagataactgagatgtgattcttgcaatcaaggagttcagagtctagtaggagagacaggtgttctgccagctctgacacaatgtgggaaatgctgtgagaacattgtgatcacagtgtgcttaaggtgccaggtaggatttcacagaggaggtgacaatttgaacatgaggtgaaatggaaagccaggagtgcccaggtaacaagtatcttatgagcaagaaaacgtcaccataggttgtttttgtttgttagtttgagatagagtcttgctctgtcgcccaggctggagtgcagtggcatgatcttggctcattgcaacctccacctcctgggttcaaacgattctcctgcctcagcctcccaagtagctgggactacaggcacatgccaccacacccaactaatttttgtatttttagtagagacggggtttcaccatgttggccaggctggtcttgaactcctgacctcaggtgatccgcctgccttggcttcctgaagtgctgggattacaggcatgagccaccgcgcccagcccaccataggttttttacacaaggcagtggcatgtttcaacttatgtgttaaaactggagtctaaggtggcaaagagagcagttaggaggtcagtataagcagcttgttaaagttactcaagaaaaataaaattcatgatagcaatataaaagagcaacaaatttccaggtctccaaaaaaaaaaaaaaaaaaaaaagttcatagcccactctactcccaccctcccttcctggaatacttgaccttaaagaggaaacacaaccctctgggtaagttctggtccagaggttggttctgcatctccaggtctagtacacattgttaaatccatgttcacacccaagcccagcagccagagggcgtagaaatcctcaggggccacctggcttggccatataccatttcttcctcctgccactttgtactctctggcctgtgtttttagagtactctctagcttctagatacaagaaacttttcaataaaaataagcaatttatctgtgtttttagtctcacagcactttggaaagtaacaacttaacccaagcaataaaatagtgatgcatgtattgtagtaaagcctgaagtttcagctttctcaatggaaactgcttcttaattatctcttatctttaacatgagattttcactattgtattctaagattcaggttatatcagcttccacatgtttttctaacttaaagtaccctctacatttaacatttttataaagcaaggtaaagatttcagcatatatgtttaaagagaaatgcaaccccaagtgagagatatcattttgatgatgatgatgatgatgatgaaaatgatgatagttataatagaaactgttatattgtgactattatatgccaggcactattctaagcatgtatatttataagctcctttgatactataacccagtgagataactgtatttccccttttataggcaagacaattcaaagcacagagaacataacagattttctcaagaacacacagctagtaaatgatgcaatcaggcttaaaccctgtccatcttgctcagagttcatggtcttaatcattaagctgtgctccctctgatactttaaatatcctatgcttttatatttaaacataataaaatgttcaaaagtttcaacttcaaaaatatgagtctgccagccttaggcatcttgtttaattgtcgcctccttgccatctagttctaggtgcaggcagtcactatgcttagctatgaaagctaccttcgaggaacagcagggagtccagagctgttgggaatgatacaaaacaaatgtaatgtttttcacctatatttgtgttctgagaaaatggaagcagtagaatatttataaatatttgttagcactcaggattctataagtttgtctttggttctcagtggcaggcaaaataactgctcctatattgaagatgcaggttcaaaggtgtgagtgtggtttgcagactggcctccgtgttccagcattcctgagacccggctttgttatctagaatgggttaccaattattaggtgtgtgctctggaagcccatagaataggcaacagtatagttcctggagctctgtcttctagataaatattatgttcatttctgaattttatgttatatggatgactaaaacacaggtgaaaatggggacataatatgattcctgttctcctgagacataaacgttaatcaaaagccacagggaaaaagatgttaatgcgccagttccagacagctgacaatagtgctgttcatgctaaagccactaaagtcagtacagcaatagccatctgttattgtctcaccttcacagatccgcttggccttcacatttttatgtacaaattcttatttctattgttttctcatttgaacagagcatcatggtccaccatcaggaacaaactcagccaggcaaagcccagccctgcagcacaggcccatgggacagtcacaggccaaccacatacctggggacaggtggggctattttcaggtttttgtttttgtttttttcttattctctccttattgctctgctgttcataaccccactccccatcatccacccccatgcagtaatgcagatgccagctgttgaggtcaaaatgacaactcttgcctgttcctcaaataccgtccccatcacctccacccattcagtaccttcgtccctcttccagcctccatcccaggcacagcataattatccaatcttgcctgacatgcgaggattagaaagaaatgacatagcatctggctctgctactcttggtcctcatagttttcatagggaagctgcagacccatatggattgctgtcttatcagaccacctgagcagagcaggttttgtgtgtatttctgtcttctttcattgaaaatattagcctagatttccagaaatccagcatcttcacgggcattggtgctgcaggagagccatttttcactgtgacagggtcagcttaactgccctctggtgtagttatttgattgcagttttctttgatataaactgctctgagatgtccttaaaaaaattgtggatgttgacagacttcaaagtatgttggaattaatgaccaggtttctcctagcacccctctgatctgattttagatatagtctgtcttcatagtggtttgtcagagggaaaatggcaaggtcgagcttttaaaagaaaagaaattaatctgcctttagactgtttttcattttctcagttcagagagtgacttgatttctctctcttgtagaagtgccctagaaggtgaaattggaaaagatgtctccacttcttacagacattcttggtcagaccacaagcaccttgcacagcctgacaccgcagtaatttcagttgtaggcagtcggcacaatcaggtaaacaaacatttccccagatggggagtgatattttgagttgccataccactggcattggtgaatttttattgcaaatcagttcagataaatttgtttccaaaactaataattctcgaagacctgccatgtgtttggcattctgctggcattcataggagaatgttaggagtgaaagaaaagtttcccctacagcaggagagctttgaacccttggttaagtacttagaagtaaatagtattttagataatcaaattcaggtttttttgtttgttacttgtttgtttccaggaaaattagtcaaacgctacttaaaggaagcactttccaaaattctgttctctgattgttgcattgcacattgaccaactagaaaagacatgtaaccttcagattaatttaggctgcatttataaaaattaagtagccctttaaccaaaacctacattccttctttacaatatagaaatgcacattgagagtataaatcatttcttccagctatagaagtaatctttcttcaaaatgtaagtaaacagtccatgagaacttgcttttcttatacttctttctctctagaaccttggttgttatccagtagagctggagagaggcccccggggctttggattcagcctccgaggggggaaggagtacaacatggggctgttcatccttcgtcttgctgaagatggtcctgccatcaaagatggcagaattcatgtgagttggtttctgtctgtaaccttaggttcaggctctagactagaaacttcgaaagatattaataattgatttaaagggaatgcaggaacctcctaaatctaaaaagcaggatttgtcatcactggtagctaaaaaaggcaaatgcttgtcattttgcttttctaacgccctgatgatttcatttcttctcttcagtgtgctaaaccatattgcagttatgccacttttgccttcttgaccttggtcaataagaaaattcatttcttattcacatagtcaacatctgagggtaaacgaattaataaatacacttttcatcttaataagagtcttgagaaagcgaggatcaaatagaatctttaactttttccaggaggcaataggcccaggattttttttccccactcttagctaccgggagaggtaactagaggctgaaaagcgtggctctcaacatttcttattgtttgaaggcctagaattcacatcagtagtattccatcatagatgttctcaactctgaaacactgtgacttcgtatagggaactgcagaccaaattgtttatagatctgcataagatagtttttccttcttctctggatgttaattaaagaggaatcttatatagaagacatttgctgctgggcgcggtggctcacgcctgtaatcccagcactttgggaggccgaggtgggcagatcgcctgaggtcgggagttcgagaccagcctgaccaacatggagaaaccccgtctgtactaaaaatacaaaaattagccgggcctggtggtgcatgcctgtaatcccagctacttgggaggctgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaatttctagacaccgttccccctactactcaaaagaattttggatttcctttccctgccaccagtaggcatcagagaaaaggaactttttttttttaattttaaactaagtaattcaattagaaaggcaaatgatcctggtaattattagatggtatattctagtaattattagaaaaggtgcttctgggtgattgcagttttgaatttttcatttcactcccattagtcatttcataaacacatattgagtgtttgcattacccaaagctttatgcatgctactgaatgagttgggagagtgactcaaaacaaataagatattatcctccctcaaaatgaccagacacatgcacaagttcaaagggatgaatagagaagatttcacagaataggtggcattgacaggtgcataggatttcaatagggagaaattaaggagagaaaacattccaggctgaataaatgagcaatggcgtaaaactaaggaagtataagtcatgtacagggaacttcaaatggttgagtttacttagattttatttagaaaatgcgtagatgaatagaggaaatgagaatataaaagccgatgggtcgcaggcataaaggtcctaggcagtgggaagccatgggaggctttttagccaggagtttcccctcagagcaatctgctgataaaaatctgttagtggtgtgcaggaaggatgaagggactccaggtagctgtaatttatgcatacagtggtagtggtgggagtataacttgaatggtaacgctttggatggaagataagagatgcatataagttcaaatttcagtgaataaaggaccagactagatgaacaacaagtatcctttaaatgagggatgaaggaaaaggaagagtaaaggatgactcagaagccttgccccatctgtactacgaaaaccatcagggaagccaaggggagaaaggatatggcaaagactgatggtgtagtaagttggagtcatgttgaggtgaagggaacagctagtagagcaggtgtaaatgtttagcaggcaattactactagtagtggtagaagcccagattgcgacattactgagaagtgatgattgaaacctttgtggtagataagatcactaaggaagaatatttagagagtacttagccaagggcagagctctgagcaaggcatgtaattagtggactagataaaataaagaaaatgggaaggcgcagcatgcagagccacagagccaaagctgcagagtgtttatgacaaagagggaccgatggccttaatacagctcgtcaagaactgctgaatctactttcttatagagacaatttcatatcgtgacaagaacatgggtttggaaatcagacaggacattctcctgagtttcctcatctgcaaaatgcagaaccatatgtaatatacatggtccaagtaaacttcttaaagtcttaataagagcatcttgagacactgtttacagaggatggcatatttattcctggttttcttggtcctttcccctcccctcccctcctatcttctcttctctctctctctctcatctctctctctctctgtctctctctcacacacacaacctattcagttactttacatctgtgtttcaatgcttctattgtaaatagtgtcacaaaaatccaattaaatgataaattaggatataattgttttaaatgttggttccaaatataaccctcagatccactaatctcagtaaaccaaaggcaaacaggccttaaagcaaagtctagttctaaacatgtcattctcagccaggagtggtggcacatgcttgtaatcccagctacttgggaggctgaggtgggagggttacttgagcccaggagttcaagaccagtctgggcaacacagcaaaacatcctcagttaaaaaacgacaacatgacatgctttatgaatgagcagaaactttagaatctaatgatgaaatcagcttttatttcaagaataaactctgaaaacaaaagcaaatgagcaattaactgttagaccccagtgtgctctaacctgtaagaaaatgtcagcttttcagagaagtcactttttgggctattaaattatcaaaatcttgacttgatacagctcatgagggctttgcatataactagtgctcaataaaatgttattgatgacaactttctctggtggccgctgtccaaatgataagagtttatctctagctgacactcgcaccacggagccacctgagtgcccctctctgcctcccccgcttgcctctcctcttctccctttattaggttgacagctgtactttgtgtcctatacctattattccgtatctccagcacctgatatggtgccttgaatattcatatcaggtgctccatagatatttgttgaaagagtaaaatgtatggataataattctagatactgagagaattattgtgtgtgtgtgtttttatttttaagatcagttcccaggacttattactgggtgaacaggactggggatatatgaagtaattagcaacaatcttagtgtcattaagaaaacaagaaatgttaatttgtaacatagatggaaggatattgagaatcattgagaggttcttcctttcggtctggttaagatttagagaggagagagaaaaaaagtgttctgggataaggaactgagaaatagctgaatggaaaaggttcatattagggaatagtgtcaaacttaaatatttaacgtagaacataatcagatttagaaaatattaagtgtttgctgtctttgaggcaacatgtattttcctacacaacatgcgtttttacttatattagtctcaaaaactctgagataggtgacattatccccacttacagatttaaaactgaggctcaaggagacttagtcacttgcagagatcactcatcctgtgcaggccacagtgtgacccaggtatgaccctagtccgtcgtcctcgaagatcggttcatgtgctttccgctatgtcaggtcttggcttgagtccagtttggattggatttcattgataggcagacagtttcttaacaggttgtgagataatataagccatgtggtagaaatattttgtcattttaatacatttgtagtggatgttgtttttaaaacgacaagactgcctataaaaaaatagtgatttgtttaaaaaagggaacattctttttccctattcttcctacttcttttcttttggttctcctattttttttcctttctcttttctttcctctctcttctctgtccccataattatttttcaataatacaaaactgaacttgaatctttgttctatttatcaaaagatgttttctccaaattattttttatcacatttttaaagtgacttaaaatgttaaaaggatgtttactgggtgaatttactcctctgaatttccctctcagaagagtctttttcatctgtagttttgtgtatgtaggtctctgcagaatttctcccactctgagggcctgtctaccataaatcttaaagcaatggctccccctccttcccctcattcagttttaaagttaaacagaaatgacacctggtggcaagtctgttcaattacaagtttttgttgttttttttttttgcagtttattgcaggaaaagaataaaaagtgttctgggttggagagcttaagctaaagaatgtgattgaaataaattataacctcaaacctgttttacaagatatgcccaaagcagtgtccaaatactatctactttaattttctttatcagcaagattatatatctagtgctaatttcttacctacattgcctcatgaaaatgattcttcttccatcatttatcaagggaaatctaagtattggcttttgtttcacttatatattctggatagtaaggggtttctaaattattctccatcctgctgtcttactttggttttattaaggtgttttcatcttacatattaaatccatcaatcttgtttctgatattgtccatttgttcaagagtaagcctcccttgtttaaaataagtatgcaataagacctttagtctatttcatagttgacttgaatttttttgcattgtatagaatggagtgcagtctacagttaaatcttcgtaatgatacactttaaaatagcttgaaaactaatatttgcacttggtatataatcatgttttatcttaagtcctcccagaatcccacgaaataggtactaatattatcctcatttaacagatgaaaaaaatgagaccacaacactagaaagaggtggagcacaagatgtgaaccacagcctcctgaccgcctgtgccatgctgtatctgtagaaagagttggcccactgacctttgttaaatattgagtccttctgttttgttacttctggattggcttattattatttctattctttagtcaccttgcagctagcttcaactcaaaggaacttctggattgttttagtaagctcttacaaatatttgagtatttgctttttggaatttcagtaatatgccattgtctaatttttctgttttgaagccagtatccttcattttacatgtcaccttgaaatatattttttcaacttttttttaataagttcagtgcggcacatgtacaggtttgttacacaggtatattgcatgattctgaggcttagaatatgaatgagttcccatctcccaggtagtgggcatagtacccaataggcagttttttagcccttgaccctctccttccctccccccatcttgtattcccgtgtctgttgttctcatctttgtgtccatgtgtactcagtgtttagctcccaattacaattgagaacatgaggtatttggttttctgtttctgcgttagtttgcttaggataatgatggcctccagctccatccatgttgctgtaaggggacatgatttcgctctttttatggctgcatagtattctatggtgtgtatataccacattttctttatccaatgcagcattcatcaacatgtgtttgcttgaaatagatttaaaatcagtaccatcattatgtttaattaggtctgttccaaagttatacttgacttttacatattttccctttttcttttaaaataactcagacatttctagtaaatcacaatggtactaaggtatatcttattctgatccctagttttatgtttattttcctgaaaaatgatttttttttttttttgagacggagtttcgctcgctgcccagactggagtgcagtggtgcaatctcggctcattgcaacctccacctcccaggttcaagtaattctcttgcctcagcctcccaagtagctgggattacaggcatgcgccaccacacctggccaattttgtatttttagtagagaccgggtttctccatgttggtcaggctggtctcgaactcccgacctcaggtgatccaccagcctcagcctcccagagagctgggattacaggtgtgagccaccatccctggccctgagaaatgattttacactaacatcactaagtttatgccagttactggttttaaataagtgttcatattaatctattctccaagtttaagtttttaagaattttaatctataaagatgtcatttattcaaatacctcatgtatgtacaggacatagcagcagttcaaaggaatgagcagttctccctggaggccaggaaaggcttcaaagataagagccctctgcccaggttttaggagatatatttaaaattcagctcaagtttgaaagtacccttcacattcggacatagctctgtagtatcatttggattgttgtttgtaaaatgtctaacatgtacccagtgctctcctgcgagagttgataagaggacagatggcagcaacaggaagagacaatgtccaggtttactcacgcataaaaaccctacacagcaagtgcccaggtttacttatgaaaatcctacacagggccgggcgcggtggctcacgcctgtaatcccagcactttaggaggctgaggcgggcggatcacgaggtcaggagatcgagaccatcctggctaacacggtgaaaccccatctctactaaaaatacaaaaaattagccgggcgtggtggcgggcgcctgtagtcccaactactcgggaggctgaggtagtagaatggcgtgaacccaggaggcggagcttgcagtgagccgaggtctcgccactgcactccagcctgggcgacagagcaagactccgtctcaaaaagcaaaacaaaacaaacaaacaaaaaatcctacacaggaaagttttatatggctattaaagatctgggcatcttcaaatcaagaaccaaattctagaatttgattaacattctaaatttgatttctataaatttagaaaattccaaatctgattctagaatttgattcttgatttcaagatgtccagatcttagttagtagccatataaaactttcctgtgtaggatttttgtgagtaaacctgaacattgccacttcctgttgtttgttgtcatctgtcctctcatcaactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtagctgaaaagttgtatattagggaggggacagaagaaaaaggaatatatatttggagaggatagatattttactagttaattcagaggtgaatgctagaaccatgaaaagctagttacatagcagagttatcataaatagtattagaaaacaagtgacttaggcaggactttcgttggaatggaatgtattttaaatttaatcagaaaaaacatatagttgtttttgtagagaaatgtacctattaaaaaagtgtattagaggcaaacaatttaaataccataaaaaatgttttaaatctcttcaaaatatcccagctttttctcttacttagctaattacacattaccaaccaatatttttatttctgtaaagcaagataagtttatattataatgaatgcgcagcatgaaaacttaggcttttctggtgactcggcaaaaacaagttgctatcaccctacctggagacagggagttggacctgagaccatttctgtcctgtattaatgttaaacttcctgggtttccatggcatgttttgaaatatcatggtatttgaaagtcactgttttttgagtgcactattctagaaataaaggcagtaccacacccacgcagtacttgcctcatctagctccccacctcctgccctaccccaccccaccccaccgcttttgagggataagtgtagacataacctcctacagtacccttccagcttatgattctctgactgtattatcttccaccatctgcttgtaaatcatatgttcccagtgacatctttgctaactgcactgattttttttttttttttcacatagtcctaggctttttctcttccctcttcaggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaatgcaagagaattattacaaatgcccatgagcctcattctggttaccacagtttggtttcctttattaattagtgattttgccatatcctaaactgtatcaattcataataattagtgagcttcttgggccacgtaatttggttcagctttataacttgtaagttctaattgggctttactaatagagaatttacagatcatatattatctcactaattatatgtaattggaaaaaatgaatattattttgtgtatataaacaacccatccttcatgtatgaacagatgtctgtacacatccgcctttatagagagatatgttgtaaacatatacaaactgtataaaatactcaggctttttaagcagttacgacaattcaaatggctgtcaaagttcaaaacgtattgttcctatttgtaattctaaaatttaataatgttccattcaaatcacttttttaggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 2408 - DNA, 295072 bp, Homo sapiens; identical to SEQ ID NO: 2407

SEQ ID NO: 2409 - DNA, 310065 bp, Homo sapiens
cagtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccaggtaagagaccgtccccacctctggctctatgtagggcgcctctccttttgcctcggtctctgagtagaaagagataggaatggggaggggttgtgtctcgtcctctgggactcgcagcaggcagtctggtagttggtcgagtggccagccgtgcacctggcggaagattcgggcctgtcctctccaggtgtcactgcggagcagggggccggacgctactggtacctgagccctggcttcgtagaagagcgagtgagcttgttaggtaccactttgaaacaactgaaaacttacgccaggttagaatacgtgtatcgaaagccagtattacctgcgctgtggaaagaaggggagtggattctacaaagatagtggaaaataggaaatcgaggtaggggatttttttgttcatccagctgcagagaactgcacactgggaagtgagtgagtgagggaagccttgtccatttcaaatcatgtttctctgtaattccttcagaaacagctgggagaggaggactgatatttataattgtaggaaaatgaaaaataaatgcctggtggtgttggagggcggggcacgaagaaatgagtctggttaggcttccacacagtcgtttttctttttaaacgttgggggtggacctctgaatctacagtgcatctattcttttcttccttttctttttaaaaggcttttttggtggggagaggaggactgcagtgctggctgcctgccttcccccacctcgtcttttgtttaaggatggaaatttcaagaaagagtgtgtggggggctaggagtggggagctgtatatttgggtgtgtatagggggaggggtatggatggagtcagaaaaaaaatccttgaaaactggaaattaatgttattctgcctggcatccggacttcaggatttttgtcagaaaataaaaagctttcattagcaacaagcccgtttgtgacaattgctgtgtgccatctgtcgtaagctcttagcacaatgcttccaggacatagacgctttaaaattgagtccggtgtaaagggtttttgtttaaatgcctaaacacacaagtatgcacacaaatgtataatacactatatacatgttacaaaaggaaataggtacttaagagactgattttttaaaattgtatttgagggtttggaaattatgttgtgaataaaatctgtagtgcaaaacaaaaaaatattgttgggtggtatataattttgggtgtgaggcaaagggattgatgactgttggtaaggaactaatttaaatgttaaaggtataatttattttaaaatgatcagtctagaaaaggaaatgattgcaaactgaaattgaggtttgcagccacagtgaggcgatggagaacaaagccttctatgtgagccacattatgcaaaatgtcccatgcatgagctgcaggtaccagcccagttcaaaagcatagttctttcactatgtcatttcactgtggacaattatgattttttttggcagtcaaatagattgaataaatagaagccctttagaatgcttttaattttatgcccagggaaaagattacagccttccatcagaatataacacaaagcagccctttaaccgggcaataggtgtattttggtagaaatccttgtgaatttgcaaatcatggatgttccaaaagccccagccccatgcacacaaagaacccttccttcaagaaaaaaggcatttttctcattcagtaaggattattatatttgtgtgtgtatgtttatgttgatttcctggtaatttcatctgattatcataggtgtacatctgcattcatgatttgtatattatcagagccattgtggctttaggatcagtggtacatgctgtttatctgtggtttatttaattttaatttttcatattttacagtttgctacaatattatttaatgtccaaagttttcttttttaaaaccataagtagaaaattgcttaacacacatctgaagatctaagtaatttaaaaatagagctaccttttataaaataatattttagttatattaatttttattttatttatctcctctcttatttttttcccttttctaatcaaataacctgtttctttatggctgctttagtcttctatactgccataggagggccagtgttttcaagaattttgaatttaggattgttcattctctgcagcacctctcaggatgacttgtttacagcaccttctcagggaggagacagggaaagaatgtgctgaaagagcatgacccagtgaaactggcacagccattacctcatcctagtaggtacttcagattcattgagagagcaggcatcctctcagtggaaaccaaacaccaggagcacacccatctcagggcaaaagcctttctcttcccatagcagcctttactaatgtcattccactgaggttaaagggatattttctcttttatgtattccttttcagggatcttgaacttggttagaaatatgtagccagaaatgaaacttggcacagaatcctctaagcctgaaggaataatttcattcctttaccccttttggtttaaaccagttcgcaaattttctaaacatcagaagggaaaaggaagaaaaatgttggtgtatttttgtgtattttcttatcacacacacatattttgtattgaattttactagcagttagacaacagactggacatgctattaacaaatgtagttgcactgttggcattttaaaaaatcattattacatttgcttataggacaataggtgcatccttcagtgattcattgatgtccttttgagactgaccatatgaaactgacatggggattttagtattcaagttggtaactctgattattgaatcctttcaatacttaatttcctcttaacagattaagataaagaatctgaaataatagttacagtagaagatagcaccacccccagatcaatactatcctccttaatgctaaaagtagtcactttaggtaagtcattagtaaatgcatgaacctgaagataacagttttgaaacaatctcaaatttttttgtctctgttatagattagttaaagatgctaataaactctttgagtcatatctgattctctcagatatatcaagtgtttttgctactttaattatctctttactattgccattacctttatctactcaatctagaccttttcatgtaaggactgtattttgatcatttcaccatattttccctcccttcacatcattctttttaattcgacatttggatgttagacttactgttctctagctattttggtttcagtaatgttactctcttgatacaaatttggcctttatttttcattaaggagagcacttattaccatttatgtatttatttattcattatgagaaacaacttttgatattctcagttttcaattgcagaaaatgattctaggcaccaaaagcagttaaaagtctgcaaattaatatgtagtacacaaaaggccaaagtcaagggagacagtctgtatgaaggtttgggtgggtgggtaggtgggtgggcgtagaggaagatgtggaatgaaagcaaattctcagctattaaaagctgtccatgtagggtagagatgagcctttttgtctaagagggtgaagaaggaataaatgttttgtttttctgtttcaacatattttgtccccatccctcccctgtcatgtctttgaactaaggccatggtgcttccttataaaaattatacagtatgtttattggaaggagttttacagtgaattaggtgaattcagaattttaaaatgatgtgaacacaattagatgaatttttatgaaaaacactttgaatctaatctttgatctttcctgttcaagacataagctttcctttgaatggtagtactttaactgtaatacattttacttaaacatttcagtaaaattctatggaaagttagacaaaataaagagctcaggatcctctttcagtctactgttaagtttatattgtggaagttggggaaagttttagacagtttgttttccgttaaaacacacactagagggggcaaatttctttttttttttttttgctttttgttatgttaatgagcaaataatttacttttaagatcacataccttgacttttttctttccttttttgtcttctttccattctcctctttcccttttcttttcttctttacttagattgctcctttctttcagtttgtattggcaaaataaacattggtctttagaaaatgaaattatagcctgatattcttattgaaatttatttttcattatatttatatttctcatttaacatgaagttttatgctaacctctcctccttctcaaggctccatccctatcttggtcctttctttgaacttggcttttatatcccctaggcttcaacagttttttccttgtataccaatctttcataacgctttgtacctcaaaaaggcctttaaaaaccagaagaaaagttactaccctatttctcccgattagtttgtatccaagtttattcaggttcccttaggttataggtaattgctcgcctcaatgtgtcctcattagccttctttgaattactttattttattttatttatttatttatttatttatttatttatttatttatttattttgagacggagtctcgctctttcgcccaggccggagtacagtggcgccatctcggctcactgcaagctccgccccccgggttcacgccattctcctgcctcagcctcccgagtagctgggactacaggcgcccgccaccgctcccggctaattttttgtatttttagtagagacagggtttcaccttgttagccaggatgatctcgatctcctgacctcgtgatccgcccgcctcagcctcccaaagtgctgggattacagtcatgagccaccgtgcccggcaattactttaaagacattttcagacaaaagtaatacatgtatacaacgaatttttttaaataaaaaatttggctagccaactgactttttattattttgttcatcagacactataaaacatggttcaactagttttttttttttaacaactagtaaagttactatgtgtcaggcagtccattgtctttatgttagttaactagttccactaatgtgtacctattaagtgaagtatgaactactctatgagcaatcagtaaatgttgaactaaattaatttaattttaagtaaaatattcctaattacatttctctgtatagcatcatcattagccatcttaatctacctcaaaaatgaccataaaatacagtgcttgaatatcatgagatatttcatcgcttaactgtctaggtcctttacagttaaagcaaactcacaagtaaatatacaaactgactctatttgagacaaaaccatcatttcaatatgaaccctttacatttatttaagtagtaatggattttaggtggctactacctttgcattacaacaatttaaaagtacaacattgtgttgttaatgcatggtgctgaaattacataatgaattggcatgagaaagtgttcatcaattttaaaatgaataatatggtatcattttgattggtattaaggcaattaaataatgctcggctttgacattttactattttatttgggtattgtacctctcaaattggtaattttctcttcccttaagagtctacctttttgagcaaaataatgtattaagtaataggctgcctattttttattgttgtttatatgattcactacgtccttttggcccactttgaaaaacaagcaaaaaagtttttaggattcagttattcattctttttatcttaataggtcatctagtatagccaggaaaatatttgattctttaatttgctacaaaacttatttattgtttgaacaaaattttcaatctgtagcatacaatttctttacttagtggatgagaacatggaattataatacttgtaacaacttctcagcctgctaattttgtctacctggtgtttcacaagggctaacatgatggtggcagtggtggtatttgtgtgtttgtgtataattactttctaagatagagttagacttttatatatttgcttttttcattggtgaaatcaattattatgcaatcagttgattccacatgagaacagttggtattaaatacaatttaatagggaaaacaatgaccaagtatttattaatgaaatcaaattagattaatattaaagtattgctgtatttttctgtttggattaagatagtccagattccattgttcattattgaaatcaaatggtaaagctaaatcttgtgctcaaaattaaaacatctccatgttgatcaaaatgtcctaagttggaatactggctacttaaatgtatcttttaagaagttcaggtgacactgcttttacatggaaaatgccctttatcttcacttaaacatcagaaaccaggactgatggaacttttaagaattttgctgctaggagaacataaaatactaagcatctactgaaacctgaatctcttataaaacaaccaagtgactatgatctaggacttatttaaaagatctttggccactgtatctcagactaaagttttgccttattcgggatgaagattatttcagagcactgagtggcctttggtgaaacttaacagtttttttcatttgtttaagttcttatagctttaaaactcagtcacgaatttcatgctttttcttcttttgtcttcagtagcaccatattgagagtggtcaatatcaaaactggcagtatgaagctttgtacaatcctggacattcttactgccttatttagtcgcttcccaaatggtatcatgagggtattaataggaatgcaaagttctccattaaaaaaatggcatttaaaatggataaactgatttttaataaaatctttttattcctaacatatttatgatttatgtaatggaataactttttgtagccctgttaattactggattagaaggactgtgtgtttacatatctggaaatatttaaaatgctattaaatgcattctttttgtaattagttaattattttttacatttacaaatgagagttacaaatacattctttatttctgtgcctctgccccatcactgaaaaggcatcaattctcaagacttgctatttatatatgaattagagaatgtttgatggggaaaagagactatcaagggcaaatgttgtgaacctgtggagtacatataagtaaactgggacagtgaccatttaagtgactttccttatctagttagtaggggaagcaggcctgagactcaataattcaggctcaaactcagtgcttggtaagaggtgtcactgaagactcatctcattctgactgccattcccaattctgattatatttctgttctctgagctgagggtggattgaggtggcagtcatacctgcccaacttcgtgactcaactgtgactttcacatggatataaaagagggaggggctcggaattctagggttattccaaccagctacatgccagctacactactgtaagcactgagactaaatctgatccaggaaacacttacaaagctactgctccagggccattcctgtggtttggatctctccggatagtagtttaaactctggggatgtgtgcccagacttggaaagccaatgagcttttctgtgagcttgaactatccatactgatgcctccagactgatttgagtctgtatttaaacttggctcaacatataaggggaatccaacaaaaataggcaggttgaaacttttttctcatctgtaatgccattaaatttccttcaaattgctttccttttgcgtttctcccagatttaacatttttagctaagaagaagtaagctagaaaggctgtgggcctctgtgtttgtgcctattttccacttaccttcctactcttatgtgccttcctgtttctctgcctacagtgctctatccctcttggttgttgttgttgttttgctttttccaagactgcatattaaataagaattgggtgttgctgtggttcctgtgttcagcagagcttcatctgcacccatgctgcttaagcgttatggaatctttagttgacaaatacttgaaagccacgaaaggcatcttaaaggaaagaaattaagtagaaattgtgcttaaatattaaggagaaacatattcctggtcactgaaaactgaaaccataccactatcaggagagtgaaataattctaatgccaccattctattagaaaattccgtgtaatatgtcttaattctctcgatgaacatgtctaatcatccatcagagtcagagtgactgttttatcactgagtagattgtacagagtttcttataatttccatatacattgatgaaaaatgggttgtgcatattggtcttcctctgaagtgtctttatgtggtacagggaataaaaccacctggattgtatatcaagagtcaacacatataaatgcagatctcttaaagtaagatatttcatactcttcttagtttattttatttggtggtctgaaatttaaataatctgtaaagaattaagataatgccttttagaacatgatgttcttacttgggagggattcactgtctctgtctcttctacttgaatatcaggctagtgtgtcctttcttagatcatagcccatggttcattcacttatttattaaacacatggttattgggttcctaatatttagtaggcacttttctgaatgtggaaaatatcagaagaaaccacataaattcctgtcctcatggagctaacattctagcagcaggagacagacattaacaagtgaaataataaatgaacatttcagacacaaataaatgctgtagggaatatacaataaacatatataatagagcttgtctgtgatgggataggctgcctttggaggcatgagtgatgagaagtagccagccacagtagtacccggaggaaaagctttcaagtgagagagagtagcctcaaagcaggaagaagcttggtatatttggaaaacagaaagaccaatggtactggagtccaacagacacggtagaggatactgggacacttaagtcagaacagaaggcaggtaccaggccacattggtccttttgaccctgataaggagtttgtcttttatttaacttgcactgcactgtaatttttcaggttgttaaaagcagaatttttttagaatctcataaaagctttcaaagattaattatatcttctaaatccctctagatatatctgtatcttatttgctaatgtgttaaatcacaagagagaaataatttagaaaatcagaaatcaatggtggaaacaagagtagacttttggtaagctgttcttatctaatgctgtaacgtaactcaaactgtgtcatttttttttggctgttggtgagttacatgcataattaattttaatcacttgtagtctctttgtaccccaaaccaagcttttcaaaacaatctaaacagaaaagtacaaattcatgtttgagggaagtagtcaaaaaaaaaattccattctcaatatgaatgggtcctttggctatttccccacagcagatttagttgtaaacaaggtcaggtgccaaacaacaaccaacattaaataacagtgtaacacacattttgcttcttagagacaatggtctaaatctcctgacaatttggtaaatgagcggatccagtttcatgataatcttgaatcatgtatgagattaataagcagtgtacctctttatgcatatattgcttatactaaaatatttaatgcacttttcagatatttatggacttagtgtaatgctctgttgagtttagctttaaatacactttgcagacatttgatttattgtactttcggcatggttcagagctgtttacttttttcctaagcatgccctcaataaacaaaattattatttttttattttgtcatattatgatagttactggacatttccaaaatatcacataatttaggagaaattaatatttttattttataatggggtatttaattattgttgatttttgtttaagcctctttccttgacttctgttttatttttaggattatttttattatgtaaattactttaatgtggaaccatttgatataaggatcttccagacttgcagttactgaaatgttaaaaatatgggacaagcatggttactcatgcctataatcctagcattttgggagtctgaggcaagagttcaagaccagcctaagcaacatagaccccaaatctacaaaataattttttttttaattagccaggtgtgatagtgcatgtctgtagtcctagctattcaggagactgaagtgaaaggattgcttgaaccatagagtttaaggctacagtgagctatgattgtgccactgtactccagcctgcatgacagagccagatcctctctctctctctctctctatatatatatatatgttatatatatatgttatatatatgttatatatatgttatatatatgttatatatatatgttatatatatgttatatatatatgttatatatatgtgttttatatatataaagcaaatcaacaaataattcaaatatattttaaattctgaatagtattcttggaattatatccaaaatatgggctttttaatattgagatattactaagcatcaaatataaattaaaatgtatttcaaaggattaatgaaagagctttaaaaagaatcagaaaagtaattaatttcttctatatagacaaccctgcttgtgctatagaatatcaaatatacagcatattgttctcctctagttgacagtcactagagatataagacataaaactagtattaaaaataatataatttacaacaatattaatggtaaaaaaaaaagtatgtcttataagtgccagcaaattcagaggagggagtgtcattgccatgtgcagaagtgaaacacattatgtcagaagtggcatgagtgtgtgtaggtttggaaaagcacctagataggacaatagcaatatcaaaggcactgaggacaatagcaatagcaaaggcactgaggtgacagtgagcaaagcaaaccagattgcatgtaatagagggttccttttggagaacagttgcctgtgtgggtggtgctggatttgtagatgtccttagtaagagatttggtttcattgtaaggccactggcatcagtgaaggatttttgacctgggaaatggcatgaggaatgtgatatattcagattagcaagaaaaatttggggaaagatagtggcctgcctagaatttctacatatggtgtagcatagagacatcaaactatttagagtgggaaactaaggtacttctttggaaattttggttacagacattttcacatacaattaagaaaatatcaacactaaagaatgggattgtgtgatgctggtggagatgggtgagagttagaagccatgcagaaatgtagtcagtcagtgaataatataggcttctattcgggttatgtcacgtgcatgccaaatatatatattatatatataatatatactatatatacagtatatattatatataatatatacagtatatattatatactatatatacagtatatattatatataaaatatatatatatgtactggccttggaaaataaagcaaaagaacaaagattaatttctatttaattccttctaatttctaggtcttaatggaaatggacttcatgacttcacagattaagttagtaaacagtttttgaaaatcagttatatgtgtgtatatgtatgttaacaaattgtctttcagaagattacaaacacattcttgttagatatttatttctaattttaaaggtttgcattaagacgtattaatatttttatagttaatgtactgtggtagggattggcaagctattttatcaaagggccagacagaaaatttttaggctttgtgggccacgcgtagtctctattacaattactcagctctgctgttgtagcaagaaagcagccacaaacaataagcagttcttatcatgttccaataaaattttattactaaaaacaagtgacagtcccatttgaccttcagactgtattttgtcaacccctggcatatgttgtcatggttgaacatgaatccagaaaatggctttgaaattataaaaaccatactgttaaaagataacaaatacatgaagactatgtgaagacaatagttaatatatttccctttatgaagtcccatggatggaatctttagatttctctcaagtcagagcatgttagatactggagactctttcctaagccactagcttggttttggaatcagtgtttgtgacgttgattttgtctccatttttttcttggcttctagtaatctcagaataaaatcgtgtcccccttcaagtaactgtgtagaatctttagtagacatttcatacactaacattttcatgcatcgttttcttatgatttctctttatcctaattttattgaatctttttattaaaaggtaaaatgtaaatcaaactacattctgtattttcatcagagatctacttttaatgaaagtctgtgaccagaacagtattcacttttcagaaggaaaagatggcatggcctttcaatcatattgtactatcaaattaggacagattgcattgttcttgttcagttttcacaactgaaatcattttctcaaaaataaattataatgtgtgtgtgaatatgctgttggaggacatttgttaaatctgttacccttgcacttaaaaaaaatggggtggatttgttgcttctgaacctttcactgttcgttatcacaaatgtcttttaaacagtttttcaaccctctcaactttagtggtcctggtaggaagatgctaagacccaggtattttgtcttataagtgcatggtcatgaaaatattctgagaattagaatttagatatgtaagcactattctgtctctctccagaatgccacatgaggttttctcattcaaactgaaatctgggacttatagtataactgtgaattttgatttttgttttgttttacatattctcatgtgaaattgtactgttgccttctaatttcgataataggtagatattgtggatacattggaattagaattaaataattggcctaattttaactgtcctattaaatcaatagtgagattgtttgactcttccagaaatgacacgatggacaagagagccccccatgtgaccattagcctgaaaacaaaaacttactaattagctgtgacttgataatgattcttagacataatcaatgggagtgtcaagggaaatggcaatattcttctttaaaaattaagaaaaatagaagaatactgtacaaaaatacataagttagaaagttcttggttgtcagatagttagtggtttgttcccccttatcaggacttgtatttgagataagtcgttcccctgtaatcatcttgcattgtttagagtcacagagaattagaaatgtaacaagttgcatttcaaccagatgtggaacatagacaacaccttgagtgatgagccataggtatagtcagaaccagatttcaacaaatattattgcctaggtgcaattgcaaggaaagtacaataggcatgagactgtactattgttatggtagtgaaatatataaagtatctcgaatattagcaagaggttacattaagctaagttagtcaaaatgaaaagatggtgttgtactttgctaaagtgagttcaattttattttcccatggcaaagaaaaaaattcgtattttattatacatatcagatacttatggaaacagtctgtagataaggatgtggatgtaaatggagtatgaatatttaaccttgagaatattattttcattattttaaaataattatttcagtaaattgcttagggttcctgtattatgcagggttattttttgcattacaaaatatttcaaaaacatgagagcagccactggaaactttgtgatgaattaagtattcatgactttgtatcttgtgattaaaacatagtttattgtgtaaataactccaccgattttattcagcatcctttttctgggaatataattaggaaaagtcattgaacaattgcagttgcctttctcaaaatattatgcaccttcttaaacctgcagagaagattctatatgtttatggagaatctcctctcaccattgagctgaggagccctggtttaggccaaggcacatctggaaaatgcttctccttagaaaagtactattggcttaaacagagtggcaccacttattcatgccatttctggactcatgtcagcatcctcaggatggaatgaaaagtaaccttacgatgacacggctctctggtggtcagatttgctgttacatatcatcttcataaaatctaggtatacatatattcaaaacacagacaatatttcaaatttttggataactacattatattattatttataatataatctaataatagaataaaatagacctcctgttggaaaaatccataccaactctaataaaaatttcattttgctcttaaaaataacatactgatttttattcggttgccatttaactgcataaaaatttttaagttagacatttgaagttatacatgaacagtgtaatgcctcctcattgatggtatataaataaagtttcttctctaattccgaggttggagagaataaaatggagaacaaagaggggtatcatatggtgattgctttgtataactccagtttgactgagtgctgttatttctgtgtacccacattgctgctctgttttgtcatttataagattatacatttgattacctaattccatgactacatgtgattgctaaggtccacatttattaatacctatacttctttgaacaagatgcctaatatgtatgtgtgtataaatgtgtacatatatataatttacaaaggacaactttgcatagactcataaaggaagtactgaaaaaaaatctaagttgaaactaaactatgactttcttggcccttgtttcagtatttttaaggtgaggataattaccaaagatctcttgagttttttgttttgttttatttttgcttcacatctaggaatctggaagtcaaattaaagctatcttttagagcaaagacttattgtttctcaggaagtgagagagagtgaacaaaatatatgccacaattgtagctccatagaaaaaggcaatgtcaacagttttaccctacataagagatgcatatcacttattggtcacattagccatttgagaaccgttagaaagtaagcaactgtcaccctttataaaattgtataaagtttatacaattttaagtcgatgttatgttatcccagtgcttggtactgggatatacaacatgaatagatatagacaaagcactgaatttatctggaggagaatgtaaataaaataacatcttactgacccctatttattttatggttttattgtccacacaataactttaaaaaatcatgataagttacaaactgttctattacactgtgtttagatttatcactctatatcattttataggccacataatttttatggaatagttcactttttaaatatttatccttgaaacattcactaatttcagttttgaagttgtgaacaagacaccatagtcactacataatttttgtttccttgtttgtacagtatttgcaatatttcattctcttattcaccatgatatcccagttgtgtctatgaagggaatggtcaataagtatttttgagtaaatcaatgaatagttttagagacacaagcttagaatcccaaaaggtttaacaaaacttatttcatcctataccaaaaaggaaatggtgagtacttttggagaaaacaagatttgaaagaatcaacactatctgtttctcttaaaaagaaaaagaaacctcattcatttgtctaaaatatccaatttttatctttgacacagaaattcttataacaccgccctcttattgagtccttgagaaagtcatttgaccctctgggccttagttttctaataaaataaggggataaatttgtctccaagactgcttgttttatggttaattggaagagcattgcattaattcacacttttacacaaatcagtcatcttagctacctgtttgctcaaaaaagactgcaatagttggaatgctggacaggtaagttttttttgtttgttttaattagggaaatctgaatgtcataaaggaaggttggaattataaggcacctttcagaggaaacaaatctatccacagtgaacacttactttatattcagcaagtgtttattaagaaccagttatgagtttcctactgtgatgagccatgttagcagtacaaagtaaaagacaatcccacatccttgccctcctgaagcctgttacccagttgaagtcagccacctcacatccttttggcaactaaacagactataaataagtgcttatcatatcactaatttacatttttaaaagtctttgggggaggaaacatacatgtgatacacttaaataagagcccagtcataattatagttgtgtgctaaaatcatcatttatggtcatgtataaaaatgatgattctaatgcataaccatgtaaataatgatacaagtaatcagagctgttggaaagatgagactgagacaaagttttgggaaaagacagatacaactttacattctttgtagattatattcacccttcctgtatctggtgtggatttttaaaagaataaaaaatcttcttgaaaaaaataatttgcaatagaaaggcaacaaggttgtttttcttcactaatgtacataataccacgttttatttctttgggcagttaagtcttaattcatcaggcgtatggataaaacattactcataaatcctttaaattttttgttatatacagatgatctaccaatgtctatttaaattctctgagaatgtcttccacttcaaatgtaaatcctttggaggacatgatgctttggaaaagaagggaaaaaggaggtatccccaaaggatttattgtactgcttttcgaagtggaggccagctgtttttggacctagaattaaaatgtaaattatcaaagggaaataatgagagccattccttttaaacaatgcccagtgcaatcagagtaagaaaaggatttagggagatttccttctatgcacaagtcacgaatgatgaagtgaaaggctgggagggaagtgatttgcaaggaactaagtgaacacaacccactgattgtctaggacacttagaagttgaattaatcgaggaacaggccttcagttctgctgggcctgaatccaaatcacaagataactgtgcatggaacttaggaagttactacattagtactatagcaggactgtaaatggaactacagtgccggcatgagttgcatttcaattcatgtggtttttgaatcaaaacagaggtcttttagcacaatgtagtcagtcagtgccacatgggaacaaaacagaaagattatacatgtttcctcaggattgtctatattaattattggacaaacacccataaaagcttttaaatttgaggattttcacaaataaattagtttttattatgtttttctacaaatgtaagtgcttcagaaaggcccagatgttctaaccagggctacatacatagagtatactcatttaactatttctattaagtcctaatatttaatgtcaatcagatgtcctagtatgtgatgaggaaataaaatgttgatgaggaaaggaaaaagtgtagatatattgatttgtaattggtttttacacaagtaaaccactaagttgagggagcaaaagaactttaacctcaaaaaattggggggtctaggggcccccaagacattgatcaatgattttgcctttttgtatgggttggtgaacaatttctgtagtgtccaaatgactaaagatcagattgcagttaatgattgaaatagtaagagattttattagcaagtaaatgtttaattatcagcttaaattttggcattatctcctcatcctctacctccagtattttattaaggtccctgactcttctttctgtttacactttcactggatgatcttttccattgtccgatatttaacaaccatttgtattctgactacttcctaatctgtatctccagtttgggaatcttccctgagagtcaggctcatatatccaactgcctgccaggtggcttcactggtgttctgcaggcacttgaaactcaacatgttcataatgaaacttatttcaatatccacccttacattcctcttagagtccccattttaggtcatggaactattccaagtcagaaatgaaaaagtcatcctagactcctaaatatatatttctttcaaatttttctccttttcatctctactgtcactgaatttgtttttcacctttcgtctgaaatatagcatttgatttccttgcctccaaacttttcccattaaattcgctatttatatgagccagagtgattgatctttcttatctgcatatttaaccaaatcactcctctgtttaaaatccttcctccagtattaatatagcatataaaaccatgcaaatctggaagcatgctatctcttcaatcttattttcagccactcccttcctgtatttttggcctcagaaataccaatctactatagtctccacacattacttgctctgttcttcccattataggttttttttttttctccttggctagctgcttttaatctttcaaaaccagctcagtttttgtatttctatcccactgtctatttatacttcttgcaggaagtaaccatcatattcatttttgtaaatccagtttctagcagagtgcctggcatatactatgtactgaataattatttgtttaaccaaacaacaatgcaggttcaccgttctgtttagcttttgctagtgattatttgattaaattggtgcttgtctactgcactgtttccctctacagagctaacattagtcaaatgctttagtataacaaatatttttatcatacttcttgatgtatgctaccagtctcttcaacgacccactcccaaagaacacttgttccattattacaccctatcctggataaactaaagactcaacctcagtttcttcacttcggccatggggatagtttatttcccaaagttttgtgagagttaactgatggagagcttatgtgaacatggaagcatggtgtcaggcacacatcattggagttgagtaaatattcagtgaattttcataaaacatgaagactcaacattttctaaaatgtttcaacaccgtcattaggaaataaagatgatgaacagctgctcataggaaagaggtgagctaaaactttaatctaccagaggaggctaccatggggctgtttccacacttgacatcactttggattctttacattcagcaaacctccaagcaaaaccagttttaggaatatattattcaagtactgagaaagaattttaacatttcctttgtataatagttaagtattttgtttcaattttagagattttcataaggtcagcagagatgtctgtatgcttgaaatctatattgttttgctcaggttaatttaatttaatggcaataaatgatttaccaagcacattaaccattaacaccagcaaagtagtcagaagtttaagacatctatctcaagttaatgcaggaaattagaacccccatctttaattctttctcggggactaaaatttgaaatgtatgtgtctctctagttcagtatttcttgtctttgctcaaggattaattatattactcagtctcaatgaataaggaaattaataattcatgcctaaatattacataggtgaacatttttgttgtactaattagtatcttgtaattaaaagtcttgtatgacaagtacgtgagactgtcggctgaaataaccatacattccaattagattcagtaagtcagtatcatttatggggaggaagcctatttgtctaaaattagaacctgggctgggctgatattttgaatcaagatctgaagtgaattttggttgcagtttagtaaaattaagatattttgtcagagggaaaatgaaaattaaagtaaaattcaaacctcattacagtaattactaaaggagtatgtaagttaattgtttaacttgaaatttaattataataactatttttatttttcaaactgagtcatcgttgaaacttagtttgctattcaaccgtgtattctttgaggaaatttgaaagacacttggtttcttgattaaaagttcttatcgggagcaatttttaaaaatagtatatttttaaaattttaaagtactttataaaatctcacactttcaaaaagaaatgtttgattgtcacatataaaaaagcttaagtcaagcttttttgtgatgatgtgttaccatcactactcttacagacatggttttttttgtttgtttgaatgctacattgtttttgcctgattctgtaatcaataaatttcctaaggactatttagttgtaattctcttgaaattaaaaaataatgtatatggatcactcagattttgatttagaatcaattgtgataccttaacacataagtatctaattagctccaaagcggcttccacatttaagtaatattaaaaattgctaataaagcctaatcctattcaaatacttctaatgggcaatagggacactacagttattttgccttcatgctctcaagagagaggtttacgttcacctttatttttgtaaactgactccatgatatgcacaatgtcattctctgctgaggtaatggtgaaagtgaatatcactgaaagcaaaagctacattataattattatgcagaatagattgacaagagtatggtttcagtgtttgggttttcttaaaaccctaaatctatgtggcacaggtttttcagcagagacgttgcaacacatttaaaacatatagccagaaatgtgggtggagacaagaaaagttggtgctcttgtttcttatggaaaagcaaaaatcactcagaacacaagatcctctgggcacgtaactaatctgtattaagagtaagatgtcatttttatgtaacatcttaactacggtgacttattaaatatgatcaagaaaatcatgttctaccaacaggactgaacttgagaataacaatcagaagcattggcaaaccattccaacacccacatcttccaagaaaattactcataatagcaatttgcattgaggtattaggcagcatgttttaataatatgtggactcaaactcaacaagaaaatatagcagctcttttctttttgtccacagaccataaaacataccataacctaaatgaacaaaaagccacatgttttttgacaatcaaaacctaagtacctacacttcctgcccattatagaataccataaaaaaatcaatgatccatcacaagatttatctgcaagaacccaaacaatagatattaaaaagaaaatatttgggttttgggggtagttgtttaaaattgttcaatttaatgccgtaatatggtcataagcttgatgtgttttcagaaaaaaaagtaaaattatttaagaaaagtgtcagttttcatatagtttcttactttttaaaattaatcatatttctattgactagtaaacctcaaacacatacattgctaaatgtggttctggcttatcatacctggtttctttagagtcatatagacctttagttaacaatttgactgtagttatgtccaaagttctgccttggaatttttccttctttgacctagctttaatattacattgtatatttcatcctttccattgaaaaagaaagatcccaagggtagcttgtatttttcaccctccaaaccccgacatcaccaatctcagttctggaaaaaaatagaatcactgcattaaattactttggaaaagttgggtagttaatgactaaaaatgaaacagactgtacattttaaaatgtagaaaattttttatttagaggcttaacctagaactgcctagacatgaatgagccaaggaaaaaaatttatggtaataccaaaagcatttaaaattacattattaaaataggtggagggaaatgaggttccagctgacttttctccccaccccattttgaataagtacatcttgttttctcaaatcacgggaggttttctttaaattttaattgtgaaaccaataatagtaggacggtgtaaagtagaaggctgcttgagagaaagaatcctactgctgtgtttaaatagagtacctttggccctctattgagatttacttgactcatccaagttcaaaattaaagagtggtattagttttccaaaacttcagaggtttgacagtgtcacttcaatagcagatattttctcagatactacttacctaggtaatgtaggtacttcaagattacctaggacctctaaggccaacctttttttctggcaaagctgcagcttgccacaacccacatcttgatttttctttctggagctaatatataagtagataactaaaagcagtaaagcagtagagtaactccttcttcttccagacagaagttctacatggacatgaaattgtggccttctttggtgcctggactaaaacatcctttttgttcagacccaagtgacatttcattaaattgatcatgaactttctatttgataaaaatgtggctttttagtggctcacaagtctgcagacttgattttaggaaagaggccactttcacagaactaccaaatattatcctaccttgaactgctgcccttttgctagccatatcttctaaactacctgttgtggatcatattggtctgtttgggctcagactttcacctttaaggttttgctagggataaaatgtaatatgttatataaccccaggctactgaaatctcctttgctagcatcttggtagcaactctctcattcatatggagaaattcttactaaaaatttgagtagccagcaaaagaaacgatagcattttgtttagaggatcttaagggacagtctcacatgctgatggagagggtagtcatgatgagggtatcaattcttgatactatcctcagtgatgttgctaaccccaaggatcccttagcagatcattattcaagccagtgtcaggttgtttcccaattctctaagtttgagacctgtactatcagtacttccaaataagagactatcagttatgtcctagttactcagagaatagtggaagataactccatgccctagctaaaagagacacaacaaggactgcaaagttcagtagagggctcaccagctctattataagtggttaactcataacttaaaattctgcttttaaagcagcccttcccaaagtatggtccctggactaagagtatcggcctcacttgaaaacgtgttagaaatgtaaattctacttcatatttactatgtttagcaagctgtctggtgattcagatgcacacaaaagttttgaaagcacggccttaatgtgcagtatcatccttcaccatgtaatatacaacaagtagaagaaaaatctactgtcctacaacagcattgctccagggtaattcaatgaggtattgaacctgaaagatgatccaaataaagaggtctattgttgaaatttgggcaacatgtataaatatgtaaaacataaaattgctctcatataatcacttgaggttgggaggtaggtagctgttataaccatgaaaagaccatttcagtagtttttcccctcctgttgaccctaaagctggcagccaatcttgcgtgctccccaaaccagaattattaataattaactgcttcccaaggattaacagaacaacatacctggactacatactaggactaaagagtcttcacttggttgtgttaatttcttgtagctgccataagaaattatcacaaacttggtgctttaaaacaatagaaatgtattctcttacagttctggaggccagggctctgaaattaaggtattggcaggatggtggtccctatagaggttccagggaagatcccattccttgcctcttctaatttctattagctgttgatgcttcttggtttgtggctacatcactccaatctttgcctcctttttcacatggacttctcttttgtctctcaaatctcctgtgtgtgtctcttataaaaggttacttgtcactgggtttcaggcccatcagatccagggtctctacatctcaagatctttaatttatacctataaaaaacctttttccaaataaggtaacgttcatgggttctgggaattaaagcatggacatatcttttggggggccaccatttaaccaccataccatgtggtagccacctgcatacttatggtacttatggccacagtttttggactagagagatatgggggactctgtaactaaagcctgcttttataatgtcattgttagagtcccataactaaccagggtaagtcttgtacgtgcttccattaggtcttccctgacttcgcacatgatttttttctaggcattagaatacggagcttccaagttcagcaccttggtctaaagaggcaaaggaagactcaaccattaggttatacattccacagtcttatttagcactgtatcacctagcacactggctggaccatagtaggtgcttagcactttttttaaaaaattaaagaagaaacaatagaatcaaaaaattttttcaggcccaacagacgcaggcagttagggaaagaacaaactgtcacgctccttattccagaactacaaaaatacttgagagggactgcttaagaaaactggatgtttagagaatgcgtttccctctccttccatgtccatagtctataccaattatctcaaaaccttttcatgacatacctattgctaaaacagtattgaacatactgtctaaaatgcatagtaatttattatacttttaatagttatgtagttcagaacttgttatatatatataaaatatagaaattgaaattaaaaagagcaaattaagcataaaataaagaataatttcaaatatcttgcaaatcacagtggcttaatatctcaaagaaaaatgtaatttgagtgagtttcatcattaatgatattggatataaagctatattgcaagtagtcttgatgatttccagtttctttgtctgacttctcatcagatctgaataggctttcattgtgtatgtctgaaaagattttgtattgaaggttagtgacactttttattgctgtgtgttgcaggagtatacttgtattatcagtattatcttccatttgttctttatgcatagggaattttttaagtcacttatcttttttattttcttttattctattttattttatttatttgagacaaagtttcactcttgtagcccaggctagagtgcagtggcgcaatctcatgtcactgcaacctccgcctcccaggttcaagtgattctcctgcctcagtctcccgagtagctgggactacagacatgtaccaccacggccagcaaatttttgtatttttagtagagatggggtttcaccatgttgcccaggctggtcttgaactcccgacctcaagtaatccacctgcctcggcctcccaaagtgctgggattataggtgtgagccaccgtgcacagccaacttacctttttttaacagattattaaacctcacatccactggccaaggcacacataaactgtcacacatgtaataagccaagagcaatgaacaagaagaaccttttcttactccctttattaagagccatccagtcatcgcttggcctcagtaacaagtggcttttgacttataggccaagtgaagtctcccatgtcaatttacagattagtaacatttcatttcagttagtcttagggaagaatcataaatataatttctaatatctacttcctacacttcagtataaatcacatatttttactgcatcacttagtacttgaatctaaaactcttcattatttgcttttgttcaagtatatttatatgctcctcagaatgtctgtaatgaagataggggtaatgtcttacacttcttcagtatcttctatatcatccaagagtatcttgtaaaaagttaatgctcacaaatactatgtgattaaggactgtagctcattggaaagtctgacttctctatgacttttttgattcattacatatatttaataaatcagagaaaaatagaaatcacctcagtgtagcttattaaaatgggcagtatagtatataatatcagaaaaatgaatgagattagaaactggaagctactgcagaattgtaattattagaattatataattattagaatttctaattctataatcattagatttctaagttatgaaataattttttttcccaagccattagcaagtttgagttttgttccttatttcttctgctgggtatgtaaagacaatatctgctggcctggtaacctgaagaatgtaatccaaatccacatacattgaatctgaacaattgagttatttatcctctgatactgatataagatacacctagatacagaaggttctataacatgaagttggactatgtttagggaaaaaaatgtataaaagataatcttcatttgctcatcacactcatccactctccacctttctctaccctggtgagggggtgagtgtgaccctaggcgtctgcccatcaggctgctgctcctctggcttcctgttggattcagacaatggggagcaagaataggtgatcagcaggtgagaaaggagcaaggccagctctttatttcccccttccctccatgccctgctgctaagattcccacagtgtctgtgcctcccaggtaagtagttcaggccccctttcctggcagtagctgtggtggggtctgtttacactgttccctccccttgctcccatggctctgaggtggtaacagttttctacttttctagccctggctgttgcaacatccctccttggtttccgtaaccttatccgtagctctttatgagagatcccttcatcaaaagcccacttttctaattggagcctgacacatacacatactaaacagggctttagtgtttaatgcagacattcagcaaacttgctgctgggtgtatgtaggcacagctgtaggaggctaaaaatagctctgtctgcaacattgttttttcttttgaaattctaagctccattttgggggactcagtaaggactttatctttaggtgccagcttttctcttgcaacctaatcctctctctactctcacaaagaacctgataatagtcaccagttacccttgttactgaccacacaatattttaaaatcgatgaattttagagaggcatacctcagcctagaactctgtttttcatctttctctcttttcaataaaaagattgtattgattgttaatgcaattttagaaagcaccaagttcatgtagaactaattgaggacccaaaagaacaccttgaaatcaaaataggctgtttgcaagtctagccttgagaataaaccatatcatttctttgaggttaggagtgtgaaagggtatgaagtgacagtctaggtatttttctcctttagagatggatctgtgatctctacaagtagacagagtaggggagagggttgacctatatgcaaatactaaagacctatttctaggagctatttggtttcagcagcttcttcaaggatgtaaaacccactttcatcctatcccctggcaggtccttctctctagaaaggcattctgtcaggaactctcctctttcctattgagcatagatcagtttcctttcatctaaacacctctgaatacattttgcattttttcacatacctagaaaaaaatcatggttagtacccctttatggtatcctgaggcatatcatatccctaggcatcccattttctttttgcctctgataatgacagggcaaacaaagtgcatctttcgaatgaaacttcatcagttggattagaataaaaccatattaaaggatggatccacattttagaattctggatagcaatatatttggtacttctagcatacagtcctatctcttataatgcttctcttcccttcagtttttagcctgcatacatacctcagtaccagccaacggttctttatgcaacctgaaacatgcagagaagtagaggggactgtttttaatatcttaccttaactcctttgctgcaatcttatagcattcttttatttaacaatcaaaaggatacacttagttggtcacagttgtctctataacactattgatcttttatatatataaataatttatacctatccatttttttcttcttcattgtaaaagaaattggaaatatttagctttaatcttttgtttttgctcaaagttcttatatttcaatcctgcaattttatttctttctgtttgtgttttctcctgcatgtctatattttaagtgtaggatagccaaaaagtgatttctgtggcttatacgaaaacacaattcatatggtgtgccttatggtctttgtgattaataccctgttattccatctcagaatgacaaaataagtgtagcgatgttgttgttccttcgatgagctatctgaacccctggatattctctgctttaatgatgcatgatcagccattatctatctcgtattttctttgtttaagaaattaatgacaaactggccatgatagtaacggtttggcattttgcttggcaaattcattcctgcataagttgaatttcatgtgttaaaaagaaagtttttttccccacttaagaaataaaatatcagattctacccacttaatatcaaagtactttaagattggaatgtacagttttaatacataacaatgcaacataacgacttaaaagggctggaagaggactaggattacatgtatatatacctatgactgttactgtttatattttttcctaaaaattaaagcctaaatcatctcaaacatttatatgtgcccattttatccttccaaataaaaagattacataatattctgttagtaactaaaattcttgtttaaaattttttttatcaataaattatttttttaaaccaaaggattccctattctttctttacatagatggggtgtcatgtcaggaaaagtgatatttctcacatgagtcactatcttaatgtggacatgattagggtacacagatggcactatatgataacctttctactggactaaaaaaaatagaggacaggccgggtgtcgtggctcacgcctgtaatcccagaactttgggaggcccagacgggtggatcacaaggtcaggagatcaagaccaacctggctaacacagtgaaaccccatctctactaaaaatacaaaaaattagccaggcgtggtggcgggcgcctgtagtcccagctactccggaggctgaggcaggagaatggtgtgaacctgggaggcggagcttgcagtgagcctagatcgcgctctgcactccatcccgggcaacagagcgagactctgtctcaaaaaaaaaaaaaaaaaaaaaaaaaaagtagaggacaaattttaatgcaattagctcagcccaggagagagtgaaaaagctcaattctaaaataagaaaaaaggaatcattcttctttctggtgtaaggcaggattgttcaaccacagctaatatgttaggaaatcatcaatatattcactgaatactgaatatataaagagagagatggagtctcgctctgtcacccaggctggagtgcagtggcacgatctctgctcattgcaacctctgcctcccgagttcaagcaattctccctccctcagcctcccgagtagctgggattagaggcacccaccaccatgcccggctagtttttgtattttttagtagagatagggtttcaccatgttggccaggctggtcatgaactcctgacctcaagtgatccatccaccttggcctctcaaagtgctgggattacaggcatgagccactgcacctgtcctaaatactgaatatcttagtaaattccactgcatagcaaactaaaagagtcttttaaaatatagaatacataatcatatgtagttgcattattatgtaaatatatgataataacaaatatttgtgtactagactaagggttaaacaggtgcattgcactcattgtgtgtgtgtgtgtaatcatttactctgtcttagtcaactttggctgctgtatcaaaataccatagattgtgtgtcttaaacagcagacatttatttctcacagttctggaggctagacagtccaataacaaggtgccagaagattcagttcctggtaaagactgtcttcctggactgtagacagccatcttcttgctgtgtccccacatggtggagaaagggggaaagcaagctctctcgtctcttcttatgagggcactaatcacatcatgaggacctcaccctgattaacctcatctaaacccagttacctccgaaaggccccatctccaaataccatcacattggaggttaggtctccaacatataaaccttgtggggacataatttagtccttaatgttttccttatacaatcttattaagtaggtaccattatcaaccttactttacaaatgaagaaactgacatgaagagatgatagataatctgtccaaggtcacacagatagtaagtaataaagttagaattttattttttgatcttattttgtctttatgaacaatcacattttaaaggcacattaaaatataatagattaacaagtagttttatctctgaaattgctccagctctgtgctgttattgtcaaagctggcctctactcatgataaccagagtgaaaggtgaaagtgtactattgtttcatatttatcatcccttgtaatgatcctcaaatgttcaaaatatggatgcatctttaggaagatttcctgacacacttcaaaaattattagcatgaattacttgtataaaatgcagagcattaataaaaaacacggcttcatgttcttaatatatgtagagctggatgactctgatatataaataaattttttaaggtttctagtaatgttttaaaaagccaccttgtaatcctggtcctgaggaatggatgtcttgcttgtggtgatttagaataactggattctcattcttaaggtattaattattcacttggctctacaccttactgactgacccacattatccttgcgagtactagcattctactactactaccaccattactgtgaatggctttttggattttctaagtgccaggcatattattaaacatgatatctacactatttcctgtaatcctcagaatgatcttgttaggtcaatgtaccccagttttactgacaactccttaggactcaaggtcaaaacctctgcatctttgatctaaagcagccataaaaagaagtgactatcactcatactccctggcatcttgtcacacttgtgcctttgagtaattttttaaatgaaccttatcatgtggtaaggtacatccgaggtgctaaatggtgaatcctgtcactttcaggaatcggaaaggatttataagatcttccagtgcatccttaggaattataatctcaaaccaagaagattggttttctgcttatagtattaaaaatatcaggtctgggagggactttagatgtcactgttctaaaccttcattttactaatggggaaactgaggcccagtgaatgaaggagccagtttaaggtaatgtaccacatttgtggtataatgaagaaccatcattttactactcaggcctcttgctctgaagcagtgtgggtcctagtgaatctatgttagatatgagaaagaatggtggaagcacaaaggctgcaaactgagtctgtatctgtgattagggaaagcctgcaaagataccaagacatacagaccatgtgggagggaggaagaaaagagccaatgacaaactaagagtagctctactttctctgttccatttattgcacttgtccttgatccctcaaagaggaagtgttgtggtcattgttgttcactgtgatcacatgttaacaagtagaggccacaagttacctgtttacttccttaggtcagacattagcctatgaaacagtgtgccttcttcatatgaaacacttagctcacaacagcatgttataaactgcaaactccatgtaaatcacattcaagaattgggagttgggataaagaacaatcttcatctttgtgtcatggtctttgttatagataaattgtcatcattataggaatcttagggaagtaaattggtggcccacttcttccaacacacacacatgtacacacacaaacacatgcacagatcaaaagaaattaggtggatcactttaaggagaaccccattccacttataggtaataattttaatcacagttaatatttagttagtgttttactgtataaaatgtgtttcaataacattatctcattcaacattacaacctgttttgaggtggtagttatttctttcttggttttacagatgaagatattaagaatcgtgaagggcgtgaatggcttggctatggcagctacccagatgagcttttgcatagatattggctcatcttttctgcactttcactgggtctggcaaaatcttcctaaattacccaccacctagtctggagaggtacttgttgacctatgtatcttatctggggagcagtgaaccagctgctagaaaatgactgcatacatgcacaagtgcatcctacgttattgctcatttttggaagcaggaatgatacagtacaaaaatggaggcctaaggaagtttattcagtttagattttttgtgtgaatgggatgctttggtatagtagaaagaatattcaaccggtggtcatataatgaagctctgaactgcaactcttatgagttctgtgacctgaacatgtagcttattctctctgagcatcaaattcctcatccattaaaagaggacagggatatccaccatatgtacttcataggattgttggaatgactaaactctatgcatcacatgaaagttctctgaaaatgggaggatacatgagaagcgttctagagatagggacatggagatgggggattatagcccaggttgtgtcctattagtgtagatacctgagtttcattgccatctttgcctttccttcttaagttaggatgatccaaagtgaaccacaaaccatgggccacagtatgctactgcccttctcaaccactcaaataaattgcagctataaaggaagatatctccacagtgtgtttttatcttgattttgttgggactgccaacttttttttgttaaattttaaaaggctgcactatgtttccagtattgattattagtgtgtcctgagcattgggataatacaaataagtaggtaatttttttttttactttggcagaactctctgctgctaaaatgccagaaatcccatttaataaagtagaatcattgtaaaaggcttggctatactcccagaacaggagattccccagtgagaaaccacctgttagtaaagtcttcattacactgtttggagtcacagaagaatgtaaattatccagagcaggcaacacagagggtctggagggaaattacctcctccctaacaactcaaagactgtatagttataccactattatatgagtggatgcattccaactataccctctgtaactaaaactttttaaaaaggaactgttctagggttagggacatggaggtagaaataatatcgagagcaaaggaaacaggaaaactgagattaagattaacaccaaccaaaatatggtccatgcaaagtaattaagtaactagaactcattcacagtaagaggtcaggctgcctattgagagatagttgagactgcctaaaggggatggtcactgtatttgaataataaagcaactgggagtttagggaaagtgaagatattttggattttctccagcatctgtgttgtttacctctaatcacaataataattcatatgggtagagctcagtatttccaaacctgaatcacacaggctgcctcctgcccatcagaagtcccatagaggtgtttgaggcatacgatgctccctccacctgcctgagaagcagtgaaggatactggttaagagcatatggtctagagtaactttgtgtaagtgctctaagctctctataccttagtcttttcatatgtcaagcagagatgatacttatatgtagcttatagggctgttggggagatcgcatgatttataatacatgtaaagtgcttagaaaggtaatgttatctgacaaataatcattgagcaaagttgaatgataaggaaatatagatcaagctattgctatttgtgaaattcattttacctctgtaagacattttaattttttccctagtattctggccctttcatgcccagtatatatagtgtactaattaagagaatgagttatgtagtccaactgcttgtgtttaaattatggctccactctttattagctctcatcttgggtaaattatttaacatctcatgcctctgttttctcatctgtaaaatggagataatgccattcatatagttttgaggttgaatagtgagtcagtgaagtgagacatggaaagccctagaacagtgcctggcacatcttaagtgcttgtccaatgctagctgtcatcatcattattattattttcctctggaacttactttttctccataactgggaccactagatacccccttaaaatctacccctttcctaatattcaagacgaagcctggcctaaagttaaagatccaggaaaacaactctaagtctgtctcagcagtgcatcatcccattctgccctccaggcagattcggatcttggtgtctagctctcatacatgggtttctactgtaattcttttgtcctgatttctattctagcactctatgagactccctggactctcttacatctgaggtgcttttctactgccttagagaacaatcacatcactgaggttcattggtaaatctctctgatgtgcactgcctaccaggccaccatgcatttttttgattagtagcagtttgggacttgcaggccctagtcttcatgcctgcaggactgtgctggatgtcctgtaggtcttggacccatcatgtttgactattccatggagcttctattcttagtacttgaaaccctctcaggcccatggagagtctctccaactcttagcccctttccttgtctttcttgcacatcagccacaacctctgatgagcaaataaggcctgttgctagattaactgatattctatgagtccaacctcctttacaaaacaaatacttggagattcagctaagtggggtaaaatttttcaactcagcacataaattattctgtttagaaattataattcagtttttacaaacctgttttaatttgtgagtacaaatgtgatatttcactgtgtgtgtgcatgtgtgcatagtttcctcaataaattctggaattatcgttttcatgaagtaagaagtatataaaatagatgaagaaattggccatcgtaatgtatgaagattactaatatctgactaaccgtgtttacaatgacggtctatgtcagctatgcctattcagaggaaaacaacataggtggttttaaaaagaacaaactggttctttgggacgtggatattggtttcataaggtagacactggccctagaaaatcactgcagtgcaataaatttagtgactcaggtgccttagagttgaaagagaaaaaaattcccttggtaactgggatatgggggaactaggagaaatgatcttccctttccctttccctttcctttccttttctttccttccttcccttctctttcccttctctccttttccttccttccttccttccttctttccttcctctttatttttttctctttcttttcactctcttttttcatcttttaactaatttataacaaattttctctttcttctgtttgtggtaagtagaatcttactttgtgggtaattaaaaaatggaaactttttggttgttgtttttttgagacagagtctcactgtgtctcccaggccagagtacagtggcataatcttggctcactgcaacctctgcctcccgggttcaagtgattctcctgcctcagcctcccgagtagctgggattacaggcacgcaccaccacacccagctaatttttgtatttcttgtagagacaggttttcaccatgttggccaggctgctcttgaactcctggcctcaagtgatccacctacctcagcctcccaaagtgctgggattatagtagtgagccactgtgcccggccaaaaaatggaaactttgaagatataaacttgtttcactggaaagtaaaaataaacaaacaacccattaaatactccagaaaacgtgattattaagtaaacttaattattactaccagaaaactattcacaatggttcaaattaaaaataaagcatttgtttaaaaatctgtgctctccaaaatgaactacatgactacttacatttgagttaaataaatgtaataaaatttgaaatttagttactcagttgcactgccctcatttcaagtgctccagagacacatggggctagtggcaaccatgccagacagtatggattcacataagtttatattggatcattgcagaaagtttgactgcatagcatggctttaaataattcccctgtttaaaattcgtagtttaatagattttttttttttcgagacggagttttgctcttattgcccagactgcagtgcaatggcacaatctcggctcactgcaacctctgtctctcaggttcaagctattctcctgcctcagcctcctgagtagctgggagcatgtgccaccatgtctggctaatttttgtgttttcagtggagacggggtttctccatgttggtcaggctggtcttgaactcccaacctcaggtgatccgccccctgggcctcccaaagtgctgggatgacaggtgtgagccactgcacctggccttaatagattcttaattaattgtttttattgtttgtttctttggtctctaatcttctagtatttcagcctcttcttttgccactcttcaggtctgttttattctcattcatctcagtactcttacacatgttattcctctgaatttccctttttcttctgatttttttctaatccatggaatttaatccagatataatctggcagaaaaccttccctggcctttactctctggtttagatgcctttagcatctaaggggcccaatagtacctcatgcttattttatgagtcatcacacttatcaaaactgtattttaattcctctcctaccttgagctgctttataaaaaatcctggtaaaatatatgaatgttaattcaattcaatttttgacaactatgaaacgttttgttctagttttcattttgagaataagtgttgtgagaaaaggggaaactggtgtttggatgtagaaaagagaaataaaatagatggcagatggttggacttttcaattagaccttatcgggcaagatcagaaaaaataaaggaggtaaaaacaggcttcagaactgcactccagtggtatccttgaaaagtgagccacgtgtaaaaaggacagtgactttgtcatggatttaacacaagaagagttaatgccatggaactaaaaatattggaccagaggtttgaaaaatacttagttattccaattaggttatttataggcaaccttttcaggcatgtacactactttgtatctctgagagctcagtagaacctaggagctgggatccaagagacaaaaagaaagtcagtctctagtcatgaaactgaaaaccactgaccaattaggagaccgcaccatgctcttactttggatgttctcttccacaaatcttttaccaatttttgctattatggtagcaataattaactattaaactaatctaattagctattaaactagtctaattatgactagtttgagatgcaaaggatataattggtttagtatttggttagagttatgtctttgatgcttgggtttagtaaataaatatattgcaaagacatcatttaaattctaacattctccacttagttttaagattttccattgtaaataatcttataatagaggcttttgggagcccaatctctttaaatgaaaagagatttttctgtaattatctgtttgtatgcctgctcttctgtcaactcccagcataatgcacacacacacacacgtgcacacaaatacgtgcacacacacatgcacgagtaacttgaagatgtcttcatcttcaagacacacatgagtgtgtcttttatttatggatcctcagaatctatctcatgtggttattgataaatgttgagatgagaaaaggcaggaagagatggaggaagaaatggcaaaaattgtttctatactgagtcttatagtgtcattctacaattataagctggctctaatcacctcatatttattcttaataatatggtcttttaaaatttgttctgataagtcatgctatttctaatttgttttatttcatacaaaataataaaagtcaacttcttaccatttcttaacttgtctcatgaaagtgttcctttggagaagtgtccctgtcgtgctttctggtctgcttttaggtaaggtctgacttctgccactagaggcctgagaatgtttttcttctttttttggcctctctctggggaggaagcagctttcaacatattctttccttgtgaatttgtaaaagttgaaatcaaggcatgcttattagttagtaattataattcttatatataccaatgagatataatcataatacatttacaaagagaaatcataaaaatgtatgtactgaaaatcagtgcccatatttcacatatgaggaaactggaatctaacctaaactgcccaggataaaagggtaaaacctgagttataacattttaactgttgctaaaagaaatcattgaaataatctatggtagttgtctcgtcccactttcttttttatctttgtagatgcgtctttattgaaagtttgaatgttggtaaaatactattatttgcctgagtcaaaggagagactgtagattcagtgaagtaaagaaaattgttggtgtagggattgccttttaaactagctctcagtcgctagatttagagtggtttatatagtttttgacatacagacatctccctcactctgagacatctaattataaacatgacaaatattacaggtgttcaaatcacagagtttaggaatgactaatggatgactggggaaaattagctgtattactgtattatttttcttcatgaacaggtctgtctacagtaacaagtccaaaatttgagactgtgctctatgccatcccaaattctttgaatgattgaaatggttcactaaaatagatgattatatctcagtataaagaaaaaattagcttgtcccttgttgacatagcttcaatgttagtctttttttctgaggaattagcacaggtacttcgattgaaaataatatagtttatattaggaactcacaaccatctatttccaactcttgaattagtttggtaaaaatctctacatgtgattatttaaagtaatgtcaatgaagtaatttagatttattcaaattatactacttaatgaagaataaattattgcagtcaggcccatttttgtaacattattaggcaatgtttgctgtttggtgtgggagagtttgaggacgcttgaaggtgacattgtttctgttttcctgaaagaatgaagctggaaaacagtgatattactctacagatattaaactatacatgattgattgattccagtccagcattcattaattatactgtatttatcagtaacacattaataataaaattgcttaggttagaaaaaaatcaacttctactaaaggttacaaagaatggattttaaaaataactgtttatctagttataaggtcattaaagacaactaatatagttttgaaaatacaatgacattaattaaaattgcctgtgttcccccaaaactgaaatcatcttgtaacatctttcttaaaaaagtgttctttttattgttagtgtaattatactgctgtgtatgtgtacatgtatatatgtatactcacacatccagataattataattgtgtgtgtaaatatatactgttctgtatctatcccacccttctcatgtaatatcataagctttcttctcaatgctgcacgcatcatatcacaggaatagactatgaccattcccccagtgttgggcattttagtttttttccaaaggtcgtgaattaataaaatcttagagctggaaggagacttagggaagatttaatccagtcccttttcttttataattagatttttatggttaggactaaggtctaaaaaagttaattgactgagagattattttatttaggaaaataatataaatgacatagttccagaaatacttttgtctaaaaaaaagtgaaagaaaaataaactaaatcagtcaaggcacattcaaaatagaataaaaaatgtgcattagtaatctatcattggagtgagtaatataacatttgctataaatatttttcacattttaaaaggcaaaataattgcatataacataacttttctagtttctatcattgtaagaggaggacacacaaaatatggtattgcatgaaaactggaaaataaatttctagtctactttctctaaaagttctgagttaatttcatgactgtatagagtgagaacatgttgaaaagcaaacctgggttttaaaattctttccattcagtagtctcagttattacaaagacaataatactttctccattctaggatgtaaccacttggcatttaacttatttttcatttccttatatttgttcactacactacaatttgtagactccataggagtctaaatgataatttggttagcaaacacccttaggtctaaaacacatgttggttcttgagagatttcccttctcctgttctagttgtgcagaggtgtaattttttaaaatagatatatcaatgggctgtacttcattttccaaaagcactgtgatggtgaagccaagcctctgaaagatcaaggcccagatcttcctcaggtttcactttagttaagactgttgcagaaggagtccaaagaatcagaaatgctggaatttgtcctgggccatgaagaatatttccttaccaaatgacccaaagctgtcattgaatgtatgacttcaagtatgatcaaacattgagcgggctggtttgtgttaaagtcccatgagactactaaagaaatggttatttagtccaaagaatcataaactattggtttgtctcagtttcttacagagtaaaatttgagagtaaaatttgattttatcagctattaatgcctacatttgtcacctaagaaaatgggatttctagtattagcttttgattaaaagaccccctacaaataaatgtatacacttgccatattccttctctcaaagtagctctaatccatactgaatactttttctagactgatttttccctaaaatgacatttggaagtagattttgggaagtttcctcacctctctaaggtttggtttccttatctgtaaaaaggactaatagtagtatcttctttatcaggttgttggttaagcaaatgaagtggtcagatcacattaaatgtccaataaatagctacatttatcaaggacctactaggtatcaagtactttacataatcatatcatggcaataatacctacccatttttcacacaaagaaagtagaactttgaatggcaacttaattaagaggtaatggagcaaagatttaagctagcttggtctgagtgattccatgatctaaatgctacatatttctttctccatgaaaacccttaaagatagggaaggcatttgtttcataaatagaagaattgaaaagaacttgtggagtttctctaatgacatggcaaaaagctaagaaaacagcagaagatcaaattcttgccactttcaaaataaaagagctacctggctctcactggatgagagggactgaagacttgaatttctctcttttcccactaacccctctcctgtgttccttactaacatttccagttgcccagtggcattttctcttgagtgtgccactgctacattaagctcagtatgtcccagtcagaactcatcacctcttccacacattctccttcttgccaaattttccttatttttaaggagaacacttcatgcccatgcagccacccagactctaattgacagagcaaaagctttctctcacccccacatttaatttgtacaaattgtgtcacttcttacctttgctatgtcttttttggactttatttccacctcacttattcaggccttctgtcccttattaaattaattgcaacgacctctttcctggggtatttctgttcagtttctacccctgtcattttgtcctacataatataccgccagaagatgctttccaaattccatcttctgtcctatcactctcctgattaatcatttctaacgtctacccaattcttaaaaaaataaatttcagcttccaacaacataccattgaggactacttaaaatatacttttttagatttgtctcttcctactactcccattcatggccctgaatctctgaccagcctggaatgatctcaccatttctcacatactctttctctttacattcttctcatcatccctttgttatgctactctttctctgtattaccattttgattctgttctaccaggtaaaatctcatatatgtattattcctaaagtattttatttctctgcatttctccttggagtaagaattatttactctttcttgtctagactgaagaggcaagataataaagagaataagagcatggactctgcagacagattgccagggctcaatctctcttctccaccacttattagccataagaccatgtgcaatttcttaacatccgtttgcctcagtttctgcatttttaaaatagggacaataatggtacctgtctcataggttggtatgacgattatattaaatataaagcacttggaacaatgcctagctcatatgaagtgctacaagaggttgttacataaaataattaagaattggctgcagcaactggtttatacttaccttatgacagggatcacattttacgtcatattatttgcatgcatatcttacctaagcctgctcactccctcagccctaatttgagaatgagatttttgcttttttttttcattgtatttcccatagtggggtttggcacttggttcttgaaaaattcaactttcatctcggtagttgactagtccattctcaatagaattattctaaaatttgggccagttttatctgatcattaatttttcacatctctcctagtaggctaatttcagtttttagaaaactaaaaagtctcatggaggattttttcagtttagtgtttctttttttttttttttttttttgagacggagtcttgctctgtcacccaggctggagtgcagtggtgcgatctcgctcactgcaagctctgcctcccaggttcatgccattttcctgcctcagcctcccggagtagctgggactacaggcgcccaccaccacgcccggctaattttttgtatttttagtacagacgaggtttcaccatgttagccaggatggtctcaatctcctgacctcatcatccacccgcctcggcctcccaaagtgctgggattacgggcatgagccaccgcgcccggcctcagtttagtgtttctttaagcacacaaagtcttacgttgagtttatcaagagtttgtccctttaacactcagcaacatgagtttcatgattcttatattttttgcaaactgcaccaatagataatgatatggtacctttggaaagagtgttacagattgcatctaattaaaccatatggatatctttgatctgggtatatattacccttacttagtaggtgaggaaacaggaggcagaggcacagggcaaccaagtaatgttgatgggactgctccagtgcctggggccaccaacatgtgggaacatttctctgtggctcttaacttccagcttccaggataacatccaagatgatactatcaggaccacactgtaagtttatgactgagccagaaactgaaccaggtcatgaaatcttactaataagaaccagagagttagaagagatttggggaatcatcttgttcaattttaaatgcgtgaatcctctttaaacagatttatgacctgagcttatttgggccttatttgaattcctccattaggaaactcattatctcttgagtcagcttaccacattttctcattgctagatagagcttcttagtctcaggccataacttgtcttcctgcagttttcactcatttgtgtaagttgttcccttaaactagatacgatatgttccattgtcttccataagatgtttgttcctggttgaaaagacagattccgtgccttccgctgagtcttcttctctgggccaaaatatgcttagttctctaaaacatttctgatgtaatttttttttatattttactttttaaaaacacaaaaattttattttggggggcatactcaagtaagtatatgcacaatacactttttttggttaatgattaatgggctctatcttctttccatctccatcttgttaggaagagaagcaatgatatgctcattccatcctttatcctttcttactctccctctgcacctgctgcagcctcccttcacaaccagtcaacctctctgcctttctgtctctgtctctctcatacacacatccctccatacacccacaggaatgtcagtgccttggttcctactcaggctaagaattacctaagcaagtgtagttcattcttgcagattaggggttataaaaataatttgtctttcagccacacacactaggatttgagttctagcattgccactcactagttatgtttctctaacagaattatttcaacttgatgcacctccattttttcaacctacaaaattgaagttatgattcttgtctcactggccagtattgactgttaagtgaaatagtaaatgtgagagtgtgtggctcacaataaatactcaagaactactggtttctgttctgtaggtctacattctcgacagcccacctaccagttttattatggtttgctgcatcaaacacatatgtttgctttcagaacttagtcatccatatttttttaatatagcaaatcttcaatgttcaaaattagtatagcatgtttgaatttaaacacttgtgattgaaagaagtgaaaatccaaacaatgctttgggcaaggcaaatgctatgcgggagaagatcattagaaacagcttgtcatgtacatgcacagtgccccttggcactgttttaaaagtggttttacatatggcaagggatcttgtatatttatctagccaagcgtattattaacgtgtcttctttagcagtttgaatttgtgctatactgtaattacgcatacatctcccctctcacagacttctcttctgccttacttagaggggaaattaagtaaaaaatatatataaacatatatattatatatataattgtatataattaaatattttttctaccttttcctgtatttttctcctgtaaaataagtgatgtcactgaactgcagtgggtaagggtaaaatctcatcagaaagatgtcttgtctttgtcaccaaaagtttctcaacctcacccgcattaacagccactgcccctggctgttctgtctccatcatagctcccatgcaccatgtactttcaattctgaggtcagctaggggcgcttggtgtggctatactaactcccaagtccagcttctctgcactaatatacctggattccaaaagtaaatactgaaagggaacacctttttgagggcaaaaaccacttgcacattatctttccccattcatcttctctaatgaacacaaacacggtcttgcttttgacaatgacttactgattttcccatatctcctgaacatgcccttcaacttgtcctccatattggagtagactaattttggaaaaatacaaacttatcagtattcatgtccctgtttaaaggtctttagtaacttcccgtttgtcttctggtacaaagacaaatctttctatgactgacaaggttctgcatggtctgactcttgcctgttttcctagtctcacttctaccattctccacattgccacattttacctcaaatacaccatgtttctcttttctaaggcaacatgcattttcttctagttcacattctcacccactctccctctttctggttaattctgactcatcctacacaggaagggaatccttactcaaactccttcaggttcttttgcctcagaatactcacttcaggttttaattatgttaaacctattaatacctgtcttctctactagattgtaagccttttgagaatgggaactgggtctggttttggtcaccaatgatatccccagtacctagcatggtgccttacatgtccttagctattgaattgttaaataaaagtaggtgctgctagggtaagggaggaatattaaatggggtttgaccattaactgttctaaaattgtaggtaaatttggtaaagaaagctattatttcaaaattaatttactaaaagtttttaagaactgtgggaactttttaacctagtacttaaatgatttttctcatgttcccaaccccccacccccggcacttaataaaagaataaagaggaaggaacgtgttctacaaatactttatttatattaattttcttttatttgatatatgttattaccttaaaaatatagttccttgagaatgaagggttaaattaggttttaaaatgccaaataagtagaaattttaatgataaggtcaaatatatgtaaacctggtctctattagtaggaatttctaactttagtaagtcctaacataaggacatgaaaatgagatattgtatttttgctgctgtgttgaaaagataaataaatcaaattttatggttaaaaggagtttcacagccaattttgctattctccccaccaccacttcatcccaatgattttccataagggttaatatgctagatatgttatgaacagctgacaattacatatcatgtaactattgatttttttaataataaattttattttgtatatatgaggtttacaacgtgatgctatgggatacataaaaataaaagatggttacaatagtgaaacagattaacatatctgtcatctcacatagaagttatagatttttaattttcatttggagcccctctgggatgttattactgatggccttcagagcaagtgtgtgtctgggctgttagccaaggatttaagttggtgactaggtttattaaggagaaaatgggtcccttaggattgttcaaggtatatcaacaccaagcttaaaactagagtcaggaagctgttgaaggccaaggtacttggcctgctgcttcatttccaccagagttctgaagggtatagccagccctgggttatgttggagttgtaaagtgacacttaaaagctcatggtcaggtgaatctcaggaaaaacgagaccttgcagtctgctattcgtttccagaagattgaagagcacaattcatcaaagtactgacaaaggcttgagtgttgaaatacctctttgtgaatgaaagaagagaagttaagcactaattaccaaagaccatttgcccccttaaaccttgagggaggaggaaaaaaaacaggattgtgtaacacagagatgagtggttagaactactcaaaaaaaaaattattgccgtcactgaaattgcttagtcattgttttatatccaagaacagtcaactgtgagttggtacaaaagcattatcatatttaatataatgctagcaatgaattagaaggaagttgagagatcttctagtcaagtctgtcttataggaaagaacataagtggattagcaattttcaaacaatgtatagggatttctgattactgttatgtatatatttattggttttacattcttctgattctttcaacatcagaccaacatctttgatggctaggattgcagtctgagctccaggagcaggacgctactccttggtgacttcatacccttcttaaagtatgtcacaaattgtcctccccacatcaactattattgcacttcctgcttagtgttgtgctgtattttggtctggtctgtctcaagtacttactagcattcctggaaccaagtttgttcatccataaatcccacgttttacagtgattgtcaggttattggtggcaaataattatactttggtgagaaaataagtggtaaaaaagtggtctgtgcctttctactcagtgacttttagaggattttactgatgagtagaaatgttgctttccttcattcttcttagtattttaatatagattaattaaataatgaaaatccatttgttaaagagttaaggtcttgagggtgaagagtctacagcaggacctaggaggtagaaggaggtatagtaccctatatatttaaaagtttgcttttgtcacatatgttttcattaagagacctgtacaattttatattatgatttatcacccccaagtgtctaaattttaatttaaaattttatacttaggggtatagaaacagataaagataaaacagagatgtatagttatctactcttacagttttggcctgccaggcaaaaagttacaggaattattaatagagatctctgaagtgtttatgagactagtttgtgatatatttaataaataccttagatatgaagtaactaatgaaaaattagaacttaggaaatagaactaaaattatttatcactgtcttaatagcaccttattaaacaatgactaaatacatatttgtatccttgtattttacagcatatattttaaaaaaattatcacatattacttcttaaggtttcactaggagaaaatgtgattatttctagcttactgtatttatttgccttatgcaatctttgtctatttctgtgtggtttcaccacttaaggatctactccgcagtgctctactcacattccacaaacctgattcatgttgttttctaacattgaaccgatctgaggaggcaaactttagaagtagtactcattaccttagatgctctctatagtggtttaccaaggggagcttgagatatgggcatactgccaggtgttgaaccaaagcaattttggctacaactgatttgtggtttaatctttgtaaatgtacttaactttggtctaagttttaggaagtcactgcaattcaatggagccaaatgtgtaagtgcctaaagacaatgactttactgcatgtgttttgtcagttggatttttttttcttagatagtgaaagttatgagtcctttgtataatttatgttacagcatgataggaaggcagttatatcgctgttaaaataattatttattgcttattccaccagcccaggaacaatgcacagtctataaaagcagattctcaatgctggtttctgacaaatagtattccattacattctaatataatagtatggaccattatattccataatctcctgctttgaagatcagtattgttataagaaagaaagagaggggagaagtatattatatatgagtgtgtatgtgtatgtattacaaaaattaactgttcgtataagtaacaaagtataactttattacaccacaaatactaggacaaatgggtgctacttaaagctcgaaatgggtgattttcaggcaaataaaataaaaccgtattttactacacagtgagtaaaatacatggagattgttactatatgcatacatatatgcaaacaatttaaatctataaataggcatgaggaaaacatatatatttttctcaattcaacaatattatttctgaatccaatttggtcaggatttatcttctccctcctgccagagataatttcaaatatctttttcactttttgcaagtaatgggttttcactctagtattattcttgattgggtgaaagcatttttttcctacctaataattttctatgtgtatgaagaggaatgagttttagctccatttcttgtcttaatcctgcagtctggaaaattgatttatagttagatatctttaaacacaatctgttacagtaaagtaatttgctcccgtcatgaagtttacataaaaatggtaacatcctactgtgtgtttatacacgtacacaaatcacaagtcagtgaatgtaaaaccatcttctgatcagttcttaaaaatgcatacttgtaagattttgtctttactcatggtaaaaatatataaactgtgtatagagttctcctcttgtttttatttatttaagccactgtatacaactctgaactgaaaggccaaatactccctttcatctctgctcagtgcaattgtcctgaaactgcattactttataacattagggaaaaacatagtatttgaaaaaataaaaacatttagaaataaatgtttagcagagatattactatttcatctaagggtacatatgagaggaaaagcctcataaaatgtaaaatcagaaattatataaaatagtgaagtacagcttaggggtcaaatcaatattgttatgttcaagtaggaaacaaccattttttgtttgaagagcaggcaataaaaaaattcagcctatttgaactactgttctattaatgtgtcaattttaaataagcatcaatctttgtatctatgtattctagtttttaatgcatatttaactttaacactatgtaattatgtcaacttgtatggaatatatttatagtacttaagtacaagaaatatgaacacggtggatcacagtttagcagtattccagaaccttctatgaagagtctctagaaaaactgtaaatttcttttctctaggaaaaactgatgagaggtcagttggtacatgctgaatgtttattagacaaagctttccatttctctctttcagagaagacaattttaatataactcaaaatgcttttttaaattttagattgaatgtattttactattctgggaacttctcatcttaaaaaaaaacaaaacaagtttcttatcatccagaatagaggaaggtgcatctagaataaacatttagaaaatactttaaaaatgggtatgaattttaagccaaagccttctcgagaccatgattgtggatcctagttttggaaatgagagttctgtccatctcaaagtgatagcagtcacttggaaagaagatctattgacctctgacataagattgtttcctatactttggaattaaacatctcagtaaaccgacgctgaagaaagagatccatttacagaaagtggtaaattagtcaaacctgtagtagtcctccccacgatttgtttttcttagtttttttttttttttcatcattctgctatacgtataattcaggctgtaatttaggaaatacaatgctacttgccactagccatcctgaaagtgaaatatagtatcctggtcagagccctatttccctaatggtgattaaaactgggcagaaagcccaatgtaataaaacagtctccaagctttttcaccaaccttggtctgggaaaagcaacattagaggttttatgtcttgaaaaatatacgacgtccatatgattaagtgctcttcattttcttctcaaccacagggtgcacattcaggccttaattgtgccagctgttctcttaacccatcacctaaatattgcttttgaatataatccgtcttgacacaaagccttttaagttttctttattacaattgatctttcttatactaaattaaacttcattttctcatttgagaaaagtgagctctttggaaaaaaaataaaaacagatttttttattctgcacatgtaaaggcaattcctttttcctgtcctaattgaattcagttaagcattcaaaaccttcatcacaaagattggctgagctatttttctttttaaacaaggccaagttttgttggcacccatgacgaagaccatactgtgagagggcaggctgccagcaggtttaacattcaagtccagagtttgatgacgtcttccccaagcttcatcaagagtcttgcaacagagccaccttgcaggccattggtgtgcgtactgcacaagtgttagtttctgtgcttttcagaagatttggaaacaatgaaagtgatccattcactttttcatatacaaaaaattaacgatggaattggggaagctgagtgaagggtatgccatagcctgggccactttgtaactgcttgtcaatcttaaactatttcaaaagaaaatgttatattgaaaaaaaagccacaaaaatgaaatatgaagaagtcaaactgtagtacataaatatggctctattaaaaaaaattaaaaataatgacaataaagaatacatcatgatttttttttctttccattgctttagccacatgtgtgaaaggttcatgctattcctaaaaccctttacaattgtctttagtggagggcacaataaagaacattaggctattctttaaccaaagggaaataattttaaatggatatttaagtctgtcttaatctctacctatgctttcttctcttccccctacctctctctccccttctctgcatcccttctaacatttttccttctttgtctctccactctgacagttctgatgttgaaaatactaaaggttgggtatggtggctcacgcctataatcctggttactctggaggttaaaatgggaggatcacttgagcccagaagttcaagaccagcctgggcaacacaagtgaggcctcctctatacaaaatattaaaaaaaaaaaaaaagccaggtgtggtggtgcatgcctgtagtcccagctactgcggaggctgaggtgtgaggatggcttgagcctgggagattgagactgcagtgagctgtgatagggctactgcactccagcctggggaacagagcgagactctgtctcaaaaaataaaataaagatactaaaaatactggtagattactcttattctattgtattaagaaagtgctacttgggctaaagttttgtagcacctgattaggatcagttaggtgtggggaaaatagaatgaaaaacaaacaaacaaaaaattctggtaaacacgtcattattgctagttacctgtaagagaatgacatcaattttagtggttaggaacccagcctctgaaatcaagcagtccagtttaaaatccctatcatgctatctcctgtgacccttagcaagtgactctctgtgcctgatgtccttatctttaaaatggagataaccataatattatctacctcatacatttattttaaaaactatgtgagttaacgcatccaaagaattcccagcatagagcagcactcagtgattattagcttaattatctaattgaagacaaatgtttactactgccaagttgaaaatgtatctggatatttgaaatacaatttacaaaacctcactatagaagaacgtgaaacaggagcagtaagagataacatagttgtgtcatggacacccagcacatcacagctgctgcgactctcctgttgcagagtccactttctaaatatatgtagggcaggcatacataaataatttaggtttttgatgtttatcatacattattaaaataccaacttctagtgactgctatcttcaactcactataaggttccgcatttttattttgttgatatgtctcccatttccactctagatttaattatctaaatagaaatgttttaattgatgtcttgtgatatttgttttaaatttgaaggaaattgcccgtattttcatcagacattctccctctaatgaaataggatggaattaaataggctgtatagattcttccagggtttgaaacaacttttttaaaaggtgtctaacatttacccagtcacacagttttattggcctgccttcatttaagtagttttatttgttgagaatcaattaagaaactgttttaaacaatgaataaagtaaatattcatttctaatgtgttagcctatgtgtattcattttcaaattacaaaagcaagtgattttttttcttccagagttggacttcagtaaacatggagtattttctaccatggaaaatacattggtttctcttttaagattgatcaattttttccttatatggttgtgcaaaaaacatatatctctccttttcataaggttctgtatttaattaaaattaacaaaagaagggattttgtggggttttgttgaaattggcataggaacctgctgaaatattaatactctgcatcacttatataaaatttcattaccagaacttcactgacatttacattagtctattaatgcaattatattttgtcatattactatttgcttaatagataggaactatgataataaagatacatttttgatcaattgtctagggctaggcagtaagtaaagaatgagctggaaatcggaaattcacaataacatggtagttagatttgcttcattaatttctaaatcttatagtaacaatgttgatttcagcattctcagaaccaaaggcgagatatatgaataagccaacaaattatagaaaaattcagagattctgtaattaaatgcagtgtacctgacccctggcttgagatagaaaatagcacaattttgaactacataaaacaatatttttagtcctgtgtttattaccaaaaataaaagtgtcaaataaaaatttaaagtttttaaattacattttaaaagacttggtaaattataactttcttcagccttagcagatataatagccgaacatttcaactgttttcaaattatgcatcaaaataaaattgagttgctagtagaaagctcaaatggttttgcacaactgagcctataaatgtgttttattgctgctgtttcccatgttttacttaaataagtcacatcaatttgtttaattaaaatgtgacagtttgagctgcatttgacatttttcacaattttcctcatcattccttacctaataatgtacatactcaaatagctgataggcttctagctaaatatgcacattgactaagagtagttaatatgaaatcagtagactgtcactgtgtcaaagagggagagcttgataatgttctgccaaggatgagggtctttcttaggagagtgacaaatagaactttagaatataataatgtagtctactagactagtagactccacttagtactataccctttagctttattaactgggactttttattccattcggagggaaactattaggttctagtttacacaaggaacaataaggccattgtacactttttgttcttacacatttaattttgaatagtgttgaatttctggctgagtctgtggatacgtggaaaaaatatttaaagatgattacaagctagcattactttatttgttgttggaatcacattgttttccttagtaacttgcaattaagatgatctaaagtttgtttgtttgtttgtttgtttgttttctttactacatactgtatgttctagtccatgagcaggatttgccaaacatgatgctgctttatgtatcagtcattttgtgttgtttgaggttaataataagatttgatatcagtatttatctataataatcaggctctttcacctgtaaatagaaaaaattttaaagagtttagacgaaaatattaatgcatatacgatataaaaagtccagaagtcctgttggtatagggatggcaggaaccaggtttaccattgtaatcattagcttagtcttgttcttccttctttctctttctctttctcactctccatcccattgtttccctccctcccactcttcgtctcattttctctccatttccctgctctgcttcatctggaaatgctgggttcatcataaggctcttactccatggtgaaaagaggtaccagtaccttcgaggttacaagattgttacatgtagttaactgagaggaaaagagaccatctcctgtacagccttcacgtatcagggaagactctttttggcttgtgttacaaactgaatttccgtgagactgactctgacacagagtgtagcttactgaatgtttcctgggataaatgtccatggaagggaaggagaaggaaacaggaatgggcagagggagaacttgagctgctttgcaacccagtgacaacatctcccaacagaagaatgcttttcagcttgcctcctattgggtgaagatggttcagccttcatactcctgcattgatccatcactggatgtgggctacccaggtaaaggaaggcaatctctgaaggggcccaactactgagctttctctactgacagtaacttcctgtggctaggacattgtttcattgatgggggactgggcggtacaccaaagtgccactccatcctaatatggcctgaattcctagctgtcaaccaatcaatgtccccaagaaatggagtccatggattgacctatactatcctatggctgaggctggggtaggattggactgtgtgtggtcaaccacatctaaatcacataaaattggctccccacaaaaaaagatgaatttgactgcagatgaaggaagggaaatgctgaactgagatatacatgacaacctctgccttaggtcacttaactatgaagccagcttgtctttaggtttctgaataaagggaattatgatagtagaatacatttttattcagaacatagaatttggatatgttttatccctaaacctctcttcttctgtgttattgagcatgtattagctcaccacgtagcatacatgaaaggacagccagcttccacaaacttctgttcatatagagttgatgatgttacagttatttgtgagttaaaatacacgagcattctcttcatttatttcagaataatgtattcctatgtgtatgtatacattgattttaccgtggaacttctttttttttaagtagaacatcttagaagagaatgcacactaggaaaagctgggatgattagaccaaaatctcaaagacagcagtagaatcagtgttgacacttcactattcttacttaaaaagtattatttgtagttctgttgtagagactgatcatgtgtcttagctctcttactaaatagtaactctctgagggcagagtgctatgcttgctttctatctcatacagtatagatatccaacattacacaatatagacatgaaaaaatgtttgcataaatgactgtcagtaagttaactgtgctgatttaaaaaaaactcacagtcatcatgagaattaaggttaaaattcagtgaaataatgtcaccatcagaaatccaatgtcagcagcattgacttcagttaattcagttaattttaacctgtcagagtcagcctctctaaaagctatgtcagttctttcccctttgacacgtgtggcaatatgtgttcaggttgatatattgttggtcataggaagtgagcagatttttgcaaacatattactgaatgaagaattaaacctccattttataccaaactttctgataggcttttaacacacattatctgattatctcaaagaactctgggaaattattacccccattctaatgatgaaaaaactgagactcagacatatttaaacactaactgatagaaaaaagtcttaggattcaaacacatggcctcagctccttccattctaccaactaccttgaatttttgcctgtttctgtaagattaaacaatatttgtagtaaataaatctgaatactaatatactacatgatagtggtctgtttaaatgaactctctgcattttacagaatcattgtctgtttttatgaaatattacagccttatactgcattttatcttgtcattcctacagctgtcctattgattagggcaaagtagattttagtatcttttttagaacatgacattatatgttaacaaagcgctgagtttagaactaaagtcctgaaattgtcctcagggctttgctaaatctagattattcatacaacactaatgactgtaaacatgatctgaaattctgcatttagaaatattttcttaacatgaattttgtgcagccaccacagagaaacaaattatgtttgcttatacttttattattggctgtaatacatgttgatcaaagacaatttgtgaatacagaaaaatgaaatgtctgaaagaagagaagaatgtgagtgttataaagtgtaccttgttttaatgtttattttattactgatacctagattcaatggtacaattaccctttgtttaaaaaaaggtatttagcctgggcaacacagtaagaccttgtctctagaaaaataaaacaaattagccagtgatggtggcctgtgcctgtagacccagctagtcaagaagctgaggctggaggatcctttgagactactagtttgaggctgcactaagctatgattttgccaccacactccagcctggctgatagagcgagactccatctcttaaaaatttttaatttaatttttgtaaaagatgtttttaaaattctttattgtattttgtcgatatagtctacctattatgggtcttgtttatctacaagaaaaatgatttttgaaattggaggcaaaagtgtaataatttactgttcagttttgcttgtgacaatgccagagtttgtgttagtttttggaaaaattttcaagtcacatgagcatcttttgccttaaagagcacacaccatttactttcatccatcctttcatcatggggaagattaaatgggacacatggagccaggaaaggtgggtgacagctgggagaaattttcttagaggcctcagagcacttccagaggattgatttgaatccattttctgccagttcctttagctttacccaggttatcatccctgcagggagctgggagctgtatctcattgaacttctgatatgttagacaactctagaacattcttaaatttccttaagcttgattccttagttaaaaaaatagaggtaaaaatctttacctcctctatttcttctaagaacaatataaagaaaatgcatttgcatttgaaaaaaatgatttttaacttgtgagggccatttgtgttgacttagtaaattgacttccccctgagtgcagtagaaaggcacagactgactttttacagcactgaacgtttagtggtaggtggtcagtggtttatattttattatcaagaagtcaaagaaaatgtatttgatggcgaggcgcagtggctcacgcccgtaatcccagcactttgggaggccgaggcattaccaagaagtcaaagaaaatgtatttgatggcgaggcgcagtggctcacgcccgtaatcccagcactttgggaggccgaggtgggtcaatcaccaggtcagcagttcgagaccagcctagccaagatgatgaaaccctgtctctactaaaaatacaaacattagtctggcgtggttgcaggcgcctgtattcccagctactcgggaggctgaggcaggagaatcgcttgaacccgggaggtggaggttgcagtgagccgagattgcaccactgcagtctaacgtgggcaacagagcaagattccatcacaaacaaacaaacaaacaaaaaacatatctttctcaatgaatttgcttgggggcaaattactgcaagtcagcaaatacttattttgtgcttttattctgccttttaaataacctggccttcttgatttgagactggctagaaaataaggcctcctcaattatttaaactattgtctattgtcaactattagccatagtgaaaaaagaaatcttcttaaagaacttaaatgtgctatctctggtcccaaaggcacattgaaatcgggccgatagaaacgcgatagcagttgtgcaccatgtctgcaactgtggcagacacacaacagaagttagtaattgagctgctcattacagacagggagaggcctgttaactttctgtaactgctggagcgtgtctatagtttctttgctgtggcactagattcatcaaatgctgagtcctcctagaggtgacgggctgaccttctgtacagactgattctgactgtcttcatgtgagtcacattgggcagcgttttggtggtaccagactgctgtcaaagcttatttccctctctgttaactgtttgaagatttatgtaccaacaggaatttaatcagtgctgtactttaaataattttgtgcttggctcaaacaagaagagttaatcaattcattagaggtggattataagccccacctcctataacttttttttttattgtgtcagaagtttggaaataaaatacatgttattattgaaaacactttattgaatgaggatttcaaaaattaggtcatttcttttcctttatttctggattgttttctcctgcatgacatttgacactttgtcaagcaaacaattgaggatagcccataaccaaagattacctgtcgttgggaagcaggtgtcacgctgatgaatcagagccagataaatctaggccaacagaggtatgtttgcttatagaactaagcaagactttctatgtggaagaactagaagaccaacagatataagctgttagttttagtgttggcaccaacactgctactataatcccacactagtctccaaatatttttgtgcacattcaaaattcacatgaatttgtcatttgcactttctaacttaacactcctgtgattaatctgtggctggatagttgtagatcagggatctgttagttggaaatgttcccttctgaaagggcagaaggttagggcctagctttcttgctgtgataaatgtcttttcagcttctgcttctttcttgttgcttaaattggggatggagaaagctcccaactaccattcattgtctaacctcataccctgctttatcttcttcatagcagtcatcattctcttaagtatttgtgttccactataggaatataagcttcaaaagtgcaggaaccttgttgacaacttcttcaccatcattatatcccagttcctagaaaagtatctgccttgccctgaagcacgtcttcaaaaaacattagttaaaagaatgaataactaacttgcttgtatattctatttgcttgggaaatcttttctttttttttaatggagtcttactctgtcaccaggctggagtgcagtggtgcgatctcacctcactgcaacccctgcctcccagattcaagtgattcccctgccccagctgagtagctgggactaccggagtgcgccaccatgcccagctagttttttgtattttagtagaggtggggtttctccatattggccaggattgtcttgatctcctgacctcatgatccacccgcctcagcctcccaaagtgctgggattacgggcatgagccgccacacccagcctagggaaaactttcttacagtagaataaagatgcagatatgtctcggttcacagtcaggctgtaaacattctatttaggtgttcagcaccacttcaattatactaaagatgaaattggtcagatcagaaatttaaccatcatttgtaatgttttgcttgtggttttaaatacgttattgaaaaattacaaatataagattgtttataggtgaattataggggaaaatgtaagttgatttaagctattttcattccaatataatactttctgctccagtgctacttcaggggaaaattaaagcattaactcttgactagtacagttgaaatataatggaatctgaggaagtacttaatatgtaacatggattaacagcagatctgtgtcatagattaatattttcagacttatgggaaaccctaacttttgctgcagctacatttgttccagacatgggatttccttttgtagtgtatagattccattagaattctgaccgttttttggtcccttttatgtaacatgaaatgcaatgataatattaaaatgtatgaaaatatactttatgataaataggtctgaagtcaattctcatatacctcttttggggatttgcaattttatttattaaattatgtagaactttagttataacagcaacacagaaggagttacctacacctggactcacccgagagaaagcctctgactcagagaagtgggtccagaaatctgtggaatgctccgttttcgcttattagtagtgcattgccaaagctttcaggaaattagagctttggggaacagatttgctttattgtcaaggattgcctatagctgtacattcctttgaaattcaggtttcactcagatgacaaaatgatggtttggtaggcctaggaggatgtgtactttccaaactggagaaaatctaggttgtggtattaatcttaaaagcaccccaatgttagacacagctgcctgcctgacatgtgcctcaggtttatcctacatgtttacaaagctcagttgtaaatctgagtattaatgagaagatgttccatgaaagattttcaacaaataattaataatgcattcagttaaccataaaggcatttcaaggaaaaactcagactttgaagacaaatgatttgaataaatggataaaaataagcttaggggcttttgcagattcatcactcaactctcttacttcattatccacataaatacagcattattcagatgcattttaaccttcaaataactcatacttcttattgctgtttttatcataaaccttgagtaaggtagcctcttaaactatttatatacctaacatagataaaataaaaattaaaaagaaggaaaaacaaaaggaacttggttgggaatatgtaagaactttttgccatacatctttgaggtaatgacaacaagtttctttaaaaaataaatactgctggattcctgggcaagacggccaaacaggaacagctccggtctgcagctctcagagagaccagcgcagaaggtgtgtgatttctgcaactgaggtacttggttcatctcaatgggactagttagacagtgggcgcagcccatggaggtcgagcagaagcagggtggggtgtcgcctcacccaggaagcacgaggggtcagggaactccttcccctagccaagggaagccctgagggactgtgccgtgagagacggagctatctggcccacatactacgcttttcccatggtcttcacaacctgtagaccaggaggttgcctcgggtgcctataccacaaaggccctgggtttcaagcacaaaactggatggtcgtttgggcagacactgaactagctgcaggagttttttttttcataccccagtggcacctggaaggccagtgagacagaaccattcactcccctggaaaggggggctgaagccagggagccaagtggtctagctcagtggatcccacccccacagaatccagcaagctaagatccgctggcttgaaacacttgctgccagcacagcagtctgaaatcaacctgggatgctcgagcttggtggggggaggggtgtctgccattactgaggcttgggtaggtggctttcccctcacagtgtaaacaaagctgccaggcagtttggactgggcagagcccaccacagtgccaaaaagccactgtagcaagactgcctctctagattcctcctctctagccagggcatctctgaaagaaaggcagcagccccagtcaggggcttataaataaaactcccatctccctgcaacggagcacctggggaaagggggggatgtgggtacagcttcagccgacttaaacgttcctgcctgccagctctgaggagggcagcagatctcccagcatagtgctcgagctctgccaagggacagactgcctcctcaagtgggtccctgacccccgtgccacctaacagggagatacctcccagcaggggacgacacacacctcatacaggagagctctggctggcatctggtgggtgtccatctgggacaaagcttccagagaaaggagcagtcagcaatctttactgtcctgcaaccttcgctgatgatacccaggcaaagagggtctggagtagacctccagcaaactccagcagacctgcagaagagggacctgactgtcagaaggaaaactaacaaacagaaaggaatagcctcaacatcaacaaaaaggacaaccaagcaaaaactccatctgaaggtcaccaacagcaaagaccaaaggtagataatccacaaagatgaggaaaacaacagtgaaaaaaggctgaatgtcccaaataccagaacacttcttctccaccaaaggatcataactcctcgccagcaagggaacaaaactggacggagaatgagtttgatgaaatgacagaagtaggcttcagaaggtgggtaatagcaaactcctccgacctaagggagcatgttctaacccaatgaaaggaagctaagaaccttgataaaaggttagaggaattgctaactagaataaccagtttagagaagaacagaaatgacctgatggagctgaaaaacacagcacgagaacttcatgaagcatacacaagtatcagtagccaaattgatcaagtggaagaaaggatatcagagattgaagatcaatttaatgaaataaagcgtgaagacaagattagagaaaaaataataaaaaagaatgaacaaagcctccaagaaatatgggaccatgtgaaaacgccaaacctacaattgattggtgtatctgaaagtgatggggagaatggaaccaagatggaaaacacacttcagtatattatccaggagaacttccccaacctagcaagacaggccaacatcaaattcaggaaatacaaagaacactgcagagatactccttaagaagagcaataatcgttagattcaccaagattgaaatgaaggaaaaaatgttaagggcagccagagataaaggttgggttacccacaaagggaaacccatcagacacagcagatctctctgtagaaaccttgcaagccagaagagagcgggggaaaatattcaacattcttaaaggaaagaattttcaacccagaatttcatagccagccaaactaagcttcataagcaaagaagaaataaaatcctttgcagacaagcaaatgctgagggattttgtcatcaccaggcctgccttaaagagctcctgatggaagcgctaaatgtagcaaggaaaaaccggtaccagacactgcaaaaacaagccaaatgtaaagaccatcgacactatgaagaaactgcatcaactaatggccaaaataaccaggtaacatcataatgatggaaatcaaattcacatgtaacaatacgaaccttaagtgtaaatgggctaaatgccccaattaaaaggcacagactggcaaattggttaaaagagtcaagacccgctggtgtgctgcattcaggagacccatctcgtgtgcaaagacacacatgggctcaaaataaagggatggaggaagatttaccaagcaaatggaaagcaaaaaaaaaaaaaaaaaaaaaaaaaaaaaagcagggatggcaatcctagtctctgataaaacagactttaaaccaacaaagatcaaaaaagacaaagaaggacattacgtaatggtaaagagatcaatgcaacaagaagagctaactatcctaaatatatatgcacccaatacaggagcactcagatttataaagcaggttcttagagacctacaaagagacttagactcccacacaataatagtgggagactttaccaccccattgtcaaataagaccgatcaaggagacagaaaattaacaaggatattcaggacttgaactcagctctggaccaagcagacccaatatacatctatagaactctccaccccaaatcaactgaatatacattcttctcagcaccacatagcacttattctaaaattgaccacataatcggaagtaaaacactcctcagcaaatgcaaaagaacacaaatcataacagtctctcagaccacagtgcaatcagattagaactcaggattaagaaactcactcaaaactgcataactacagggaaaccaaacaacctgctcctaaatgactactgggtaaataacaaaattaaggcagaaatcaataagttctttgaaactaatgagaacaaagacacaatgtaccagaatctctgagacacagctaaagcagtgtttagagggaaatttatagcactaaatgcccacaggacaaagtgggaaagatctaaaattgacatcctaacatcacaattaaaagaactagagaagcaagagcaaacaaattcaaaagctagcagaagacaagaaataactaagatcagagcagaaatgaaggagagagagacatgaaacacccttcaaaaaaatcagtgaatccaggagctagtttgtttgaaaagattaacaaaatacatagaccactagccagaccaataaagaagagagaagaatcaaatagacacaataaaaattgataaaagggagatcaccactgatcccacagaaatacagactgccatcagagaatactataaaacacctctacacaaataaactagacaatctagaagaaatggatacatttctggaaacatacaccctcccaagactaaatcaggaagaagtcgaatccctgaatagatcaataacaagttctgaaattgaggcagtaattaataggctaccaaccaaaaaaaacccaggatcagatggattcatagccaacttataccagaagtacaaagaggagctgttactattccttctgaaactattccaaacaataaaaaaagagggactcctcactaactcattttatgaggccagcatcatcctgataacaaaacctggcagagacacaactaaacaagaacatttcagcccaatatccctgatgaacatcaatgcgaaaatcctcaataaatactggcaaaccaaatccagcagcacatcaaaaacttatcgactatgatcaagttggcttcatcctttggatgcaaggctggttcaacatatgcaaatcaataaatgtaatccatcacataaaaccaatgacaaaaaacacatgattatctcaatggatgcagaaaaggcctttgataaaattcaaaaccccttcatgctaaaagcactcaataaactaggtattgatgaaacatatctcaaaataataagagctatttatggcaaacccacagccagtatcacactgaatgggcaaaagctggaagtattccatttgaaaactggcacaagaaaaggatgccctctctcaccactcctatttaacatagtattagaagttctggccagagcagtcaggcaagataaagaaataaagggtattcacttaagaatagaggaagtcaaattatctctgtttgcagatgacataattctatatttagaaaacaccatcgtcaggcccaaaatctccttaagatgataagcaacttcagcaaagtctcaggatacaaaattaatgtggaaaaatcacaagcattcctatacaccaataatagacagacacagagccaaatcttgagcaaactcccattcacaattgctataaagagaataaaatacctaggaataaagcttacaaggatgtgaaggacctcttcaaggagaactacaaaccactgctcaaggaaataggagaggacacacacaaatggaaaaacattccatgctgatggataggaagaaacaatatcatgaaaatggccatactgcccaatgtaatttatagattcaatgctactctcatcaagctaccactgactttcttcacagaattaggaaaaagctactttaaatttcatacagaaccaaaaaagatcctgtatagcctaagcaaaaagagcaaagctggaggcatcatgctacctgatttcaaactatactacaaggctacattaaccaaaatgttatggtactggtaccaaaacagatacatagaccaatggaacagaacagaggcctcagaaataatgccacacatctacaaccacctgatctttgacaaatgtgacaaaaacaagcaatggggaaaggatttcctatttaataaatggtgttgggaaaactcgctagccatatgcagaaaactgaaactggaccccttcgttacactgtatacaaaaattaatgcaagatggattaaagatttaaacataatacctaaaaccataaaaaccctagaagaaaacctaggcaataccattcaggacataggcatgggcaaagacttcatgactaaaacaccaaaagcaatggcaacaaaagccaaaattgacaaatgacaaatgtgatctaatgaaactaaagagcttctgcacagcaaaagaaactgtcatcagagtgaacaggcaacctacagaatgggagaaaatttttgctatctatccatctgacaaagggctaatatccagagtctacaaggaacttaaacaaattcacaagaaaaaacaatcccaccaaaaagtgggcaaaggatatgaacagacacttctcaaagtaagacatttatgtggccaacaaacatatgaagaaaagctcctcatcactggtcattagagaaaagcaaatcaaaaccacaatgagataccatctcatgccagttagaatggtgatcattaaaaagtcaggaaacaatagatgctggagaggacatagagaaataggaatgcttttacactgttggtgggaatgtaaattagttcaaccattgtgaaagacagtatggcgattcctcaatgatctagaaccaggaataccatttggcccagcaatcccattactgggtatatacccaaaggattataaatcattctaccataaagacacatgcacttgtatgtttattgcagcactcttcacaatagcaaagacttggaaccaaccaaaatgcccatcaatgttagactggataaagaaaatttggcatacatacaccatggaatattatgcagctataaaaaagaacgagttcatgtcctttgcagggtcatggataaagctggaaaccatcattctcagcaaactaacacaggaacagaaaaccaaacaccacacattctcactgataagtgagagttgaacaatgagaacatgggcacagggcagggaacatcacacaccggggcctgttggggaggttgggggcaaggagagggataccattaggagaaatacctaatgtagatgactgtttgatgggtgcagcaaaccaccgtggcccatatatacctatgtaacaaacctgcatgttctgcccaggtatcccaaaacttaaagtataattaaaaaaaaaaaaaagccagctaaatcccactgaaaccaagatggttatgagagtgacctttggtcatcctcactgctatagtcctaccagcgccatgacagtttacaaatcccatggcaatatcatgaagttaccctgtatggtctaaaaaggtgaggcatgaataatttaccccttgttaggatataatcgagaaataatcatacaaatggacaaccaacagccctcagggctgctatgcctatggagtagctattctttattcctttactttcttaatagacttgctttcactttaaaaaacaaataaataaatattgccatcttccaaagtttttgtcccactgaaaacacagaaagaactaaaagagattgagatattttcatttcaaaaatttatcattggttttcaggtttcttcaaagcatgttttcccctattgtttctgcctgaatttgaatatgccagaactccttagagaattatataggtaggaaaatctgtcagtgctctaaacttaaaaacagaagatgaaaaaataatatatgctggccatatatgtgtatatattccaccttatctgtgatttttgttatttctttgccttaataaaagacatcggtaaacaaagccacccgaagtttggactgggcggagcccagcacagtgccgtaagctgctgtagccagactgcctctgtagattcctcctctctggacagggcatctctgaaagaaaggcagcagccctagtcaggggcttgtggataaaactcccatctcccggcgacagagcacctgggggaagagggggatgtgggtacagcttcagccgacttaaacgttcctgcctgccagctctgaagagagcggcagatctcccagcacagtgctcgagctctgctaagggacagactgcctcctcaaatgagcccctgacccccgtgcctcataacggggagatacctcccagtaggggatgacagacatctcatacgggagagctccggctggcatctggtgggtgtccctctgggacaaagcttccagaggaaggagcagtcagcaatctttactgtcctgcagcctctgctggtgatacccaggcaaagagggtctggagtggacctccagcaaactccagcagacctgcagaagagggacctgactgtcagaaggaaaactaacaaacagaaaggtactggatattcaatctttataagcttagttttctcctaggaataaaaatagtatctgctgtgtttggcctttgtgaggattaaatcaataatgcatctgacaaactttgtagaatgattgagttgtattaaacacttaatactcatttcctataattgttactcatttcctataattgttgttttgtattagaatggtactctagccttcataaaacaaattccatgatttagacatttgaaagttcttcattttcaactgacatttatttctagttactgcatcacctagtcattttatgttcagtgttgtgacagcaaatgggtgaaatagtttcaatttcccagcatgtaactggcctttttagccttaactttcttttccagcattgttacggcagctacagcaaacatgtcagagtacagaacattccattaagagccttatctcatgcctcgcttcctatgatgttttgtatgaataatacaatgtctagaggtgaaattagttggagtgctcatgactcagcctctttttctggggagtgagtcattccacatttatagattcctgactttgtgccgtataccacactaagtgcttggaatacaaacatagatttgctgggtcattgacccagagcagcccacagtctgggcaggcagggtatggcattcattaagaacaatatgggcttacacatagccagcactctattaatgttatatctacctgtcaaggcaaagtgtgattaaatatacaataatatgagctgtctagacaacttaattctatgttttggaacatgtacctctgaccctatagccctatattggtatattttgcctaattatatcaccacaaatttaactcctttattgttttgtttggatactgagtttttattcctttgcatatcacgtaaaatcataccctccatgaataggtcagttgcctgatgaatacctttcctttattatcctgccagaaactcacacttaatgtgtctaataaagcccattatcctctacttttacccagcaacctgatctcccttcaggctttcctgtttctaagaatgtactgggagtctgtttttcttacactctcaaaattctcttggctcctttcttcatcctgtgcctttcctggccaatgaatccttaaattctttttttgtgtgtgtgagacagggactctgttgccaagggtggatttcagtggtgcaatcatagctcactgtaacctcatatgcctctggcttcagcctccccagtagctaggactacaggtgtgcactaccatgcctggctaatttaaaaaaaaaaattgtttttgtagtggtctctctatgtcgcttatgctggtttcaaactcctggcctcaagcagtcttctgccttggtctcccaaagtgctgggattagaggtgtgagccaccatgactggctttaatccctaaattctgtatggactgtaaatactgttatggactgagttgtgccccaccccatccatatgttgaagttctaagtgcccgtgtgactgtttaaaaatagggcttgtagcaggtaattaaggttaaacaaagtcatcagagtggggccctaatccagtagggttggtggcctcataagaagaggaaaagagagttctctaaatttccccacccatcttcatgtctttctttctccgccatgtgaggatatagtgagaatgtggctgtctacaagccaggaatatagccctcgccagaacctgaccatgttggcatgtgatctcacccctccaacctccagaactgtgaaaaagtaaatatctgttgtgtaagccacatgtctagggcattttgttatgttagactatattaggccatctcttgcattgctataaagaaatacataggactggaatttacaaagaaaagaggtttaattggctcacagttctgcgggctatacaggaaacatagtgctggcatcagctcatggggaggactcagggagctttttctcctggcagaaagcaaagcaggagtgggcacttcatgtagtcaaagcagaagcaagcaatggagagaacaagagagaaagagagagtagaatgggaggctccacattctcttaaatgaccagatctcatgaaaactcactatcacaaaacagcaccaagccataagggatcacctccatgatccaaacccctcctactaggccccacctccagcactggggattacaattcaacatgagaattgggtggcgacaaatatgaaaactatatcatcctgcatctggtcctttccaaatttcatgtccttctcacattgcaaaatacagtcatgctttcccaatggttccccaatgtcttaactcattccagcattaattcaaaagtacaaagcctcatttgaaacaaggcaaatcccttcaatctacaagcatgtaaaatcaaaaagagttatttactcccaatatacaatgggggtataggcactgggtaaacattgatattccaaaaggaagaaattggccaaaggaaaggggctaaaggccccatgcaagttcaaaacctagcagggacagttattaaactttaaagctccaaaataatatcttttgactccatgtcttacatccacagcacactggtacaatgagggggctcctaaggccttggttagctctgcccttttagctttgcagggtgcatcctccccatacccctcagatgctctcacaggttgttgagtgcctgtggcttttccaggtgcaggatacaagctgctggtctgaggtctggagggtggtgacccccttctcacaactccactaaggaatgccccagtggagaccagatgtgagggttccaacttcacatttcctcttggcactaccctagtagaggttctctgttggggctctgcccctgcagcaggcttctgcctgggcatccaggcttttctacacatcctttgaaatctaggtggaaggtgccaagcctcattcactcttgcactctgtgcacccgcaggcttaacaacacatggaggctgccaagacttacagcagtttgtgctctccagagcagtggtatgacagtgtctggggtcctttgagcacaggctgcagccagagcttccagtgcagtacagtatcctaaggctgtgccaggcaatggggccctggacctggcccacaaaaacattcttccctcataggcctctgggcctatgatgggaggggctgccatgaaggtctctgaaatgccttcaaggcctttttcccattatcttggctgtgagtgtttggtggggtttcattatgcaaatttctctagcaagtggttgttccacagcctgcttgaattcctctctcaaaaaaagctttttctttctctgccacatggttagatgaaaaattttctaaacttttatgctgtgcttcccttttaaatataaattccaattcttaatcttttatttgctcctgcttctgagtgtaggttattagaaacagccaggcctcctcttgaatgtattgctgctcagaaatttcatctgccagatatgctgtatagtcaccatgaagctcaaacttccaaagacccctagggtatggacacaatccagccaagctctttgctaacacataaaacatgtgacctttgccccagttcccagtaagttcctcatttccatcagagacctcatcagcctggattttgctgtccatatcactatcagcattttggtcacaacaatttaactagtctctaaaaaattccaaactttccctcatctttctgtcttcttctgagccatccagactcttccaacctcagctcattacccagttccaaagctgctttcacatttccatgtatctttatagcaacaccccactcttcagttcaatgtattaggctgttcttacattgctataaagaaatacccaagactgggtaatttattaaaaaaataagtttaataggctcatggttctgcaatccatacaggaaacacagtgccggcatcagcttctggggaggcctcagggggcttttactcatggtggagagcaacacaggagcaggcacttcacatggtgaaagcaggagcaagccagaaagagagacagggggtggggaggaaaaggagagggagaatgccgggaggaggtggcacacacttttaagtgactggattttgtgagaactcactatcatgaagacagcaccaagccatgagagctctgcccccattatccagtcacctccctccaggccccacctccaacaatagggaataaaattcaacatgagatttgggtggagacaaacatcagaactatatcacagtctcagcagactaatacacatatccatgcaatagttgtaacactctcctttatatggacactgtctccacctgaattgtgtcttcattaccattcacctggacttctgaaggagccacttttttgaacacttctttaagcactcccctctctgatccaatctacataatattgccagattaaatttcctaattatgccattcttgaatttaaaaccttcagtggtccactttcacctacaaaattaaatatgtttaattgaatagcctcctcagattgtcattcaaggtcattacttcctatatagagccaacttagcttttcacccaattattgctcttcttatgggtcatactccaggctaggtatttttccaaacaccccctgggctttgattcttctgttactttgtttctgtgttgtcctgtccattgtctgaattgctctccttcccactccatctccacctatcaaaatcccttacctccttcaagggctaactcaaatgcaacttcctctgtgaatctttatcttcataacaggatttttctccccttcactgatctcccaaaagccctgttagtatttccttgtgacaataggaattttttttttccatcgtggctttttgtcttttggctttttcacaacctcccttatcccactagattctaactaagtgaactctttaaggttaaagaacattggatccctaaaatactaaatgatactaaaaaacataacaaacaaacaacaacaaaaaaaccctacccagttgggtatggtggcttatgcctataatctcagcaatttcagagggtggatcacttgagcccgggagtttgagaccagcctgtacaacatagggaaactctgtctctaccaaaaaaatagaaaaattagttgggcatggtggtgcatgcctctagtcccagcaactcaggaggctgaggcgggaggatcatctgaggctggggaggtcgagactggagtgagccatgatcattccaatgcactccagccgggacaatagagtgagaccctgtctcaaaaaaaaaaaaaaaagcctactctataccttaaaaatatgagaattacaagaattacaaacaaaaaacatttccatttttttaaatataactgcagtattcccaacatttgtttctgtaaggtgtaactccagtagtaacttttctgttacttaagcagtaacaatttctgtaatttgaaaactcaagtgtaactttaacaagggagaagcataagaaatataaaaattgtgaattttcagctcacaattaattttgataatccaatagctaaaagatgtctgctattttcatcttgtattccttgtgaggtataatcaggcctatttgagtttgacataggctttataatgttatctgaccatcacaatatgatttataatatggaggcatgaagtcatttctcattggggcaggagtgtggcaagggggaagaagagctttaccaattaactcaagattatttggtgacatttctcttaccttttaggtgaggagaaagagacagaggatggagaattggtgcttttagtatgctgatacattaagctgcctggaagcagatgctaaatcctattgaaaataattttatttgcgttttgcttagggtattgtttagcaaaatactacacaaaaagtcttgacctgtgtgtttgaaatggcagatgttcacagtgaggactgagccttggggcaacatcaatcttcacaattctgcacctatttgctcaataactggcttggttggaaaaaaaggaaaaaaaaaagttccagggagttatttacaaagcatccgctcctggcactgcaaatgaaagtgctctccttaagataagaaaagcaagcaaacaaacagaagccacaggacagcttgagcccaccaggtcaaaaatgaatacctcttttccctcagaactgtgtttccaatatttttatataaaaattgtatatatttaagtgtgcaacatgttttgatatatatatatacacacacagtgaattgattactagagtgaagcaaattaacatgtctgtctcctcacacacttattgttttaaaaaataagaacacctgaaacctattattttagcaaattttcagtagaccttacaatattattaactatagtcgtcatgctatacattagacctctaggtttagtcatcctgtataattgtgaccttatatcttttggctaacatgtcctcatttcgccaacctccccacctccagataaccaccattctactccgcttctatgagttcagctttttaagattccacataagtgagattatgcagtatttttctttctgtgtctggcttatttcacttaccataatgccgttcaggttttttcatgttgttgcaaatggcaggatctcccttttaaagtcttaataatgttccattgtgtatagtaactcacaattttttaatccattcatctgttgatagacactggttgttttcatattttgactgttgtaaataatgctgcaatgaacacaggagtgcagatatctcttcaaggtaccgacttcattttctttgtgtattttccctgtagtgggattgctggatcaaattgtagttccctttttaatttcttgaggtacctccttactgttttccataccgcttgtaccaatttacattcccatcaacagtatacagtgttccctttccttttcaccacatccaacacttattttttatcttcttaatgatagccatactaacaggtgtgagatagctatctcattgtggttttgattttcatttctctgatgatttctgatattaaacaccttttcataaacttgttagccattgtcatgtcttctttggaaaaatgtctattcagggtcctttgctcatttttaaatcaggttatttttatttatttgctttgagatattgtttcatgtgtgttccttatatatttcggattttttttctttttttttttttttttctgagacagggtctcattctgttgcccaggcaggagttcagtgcacagtcacagctcactgcagcctcaatttcctgggctcaatcaaacctgccacctcagcctcctgggtagctgggacaacaggtgcacatcacaatgcccagctaattttttgtattctttgtaaagttcgggtttctccatgtttcccagactggtctcaaactcctggactcaagcactccaccctccttggcctcccaaagtgctgggattacaggcatgagcccccacgcccagccctatattttggatattaaccccttatcagatatatggtttgcaaatattttctcccattctctaggttacctttttattttgatgattgtttccttttttggacagtttgatgtagccccacctgtttgtttctgcttgtgatgtctgagctcttggtgtcatattcaaaaaatcattgccaaagtcaatgtcaagaagcttattccctatgttttcttctaggagttttatggtttcaggtcttacatttaagttttcattccattttgggttgatttttgtgcatgatgtaagataaaagtctattttcattcttttacatgtagtacccagtttacctaacaccatttattgaagagactatcctttcaatggaagtaatgtaagacaaggatgggattttattttcttattctcaccacgaagggtattttcaactgtttctttaaatctgacatagaattggaaaaaatacgacagtaagcacctttattcatttaacaatatttattgatattttgtgtgctgcaaacgttgggttcaaatacaaagttcacatacctaaaagagtattaatattttgaatacagtttgtttttgaatcatgctgtattgaaaccccatctctactaaaaaatgcaaaaattagttgggtgtggtgaaacgcacatgtaatcccagctactcaggaggctgaggcaggagaatcacttgaacccaggaggtggaggttgcagtgagctgagatggtgccattgcactccagcctggttgacagagcaagaccctgtctctggaaaaaaaaaaaaaaagagagagactaagcaagatttttcttggagatggggcttccagttgtggggaggaggaacactggaagagggacaagtaagttggaatgtctttccagacacattatggaatacataaagaagtcaggctcctgtgtcataaaactgaactttaaaaaaaaaaatcccacagtatcattttgtttttgctatgaaagtatatatttgggagtgcacgtagaagaaatgaaatccagtctatttaaaagaatattaaagatatcaggatgctgatttgtgttaaagagcaattagcaagaagtagctatagtcaaatgataaattgaggcctaaaacttgcaagcaaacaaatgggcagtttcaggttagactttccctgactccaggcaactagtgaaccactttctctttaaagagttgttaagtggcaatatcatcctggtattcattgctcagtatgcatttatcaattgtagagcaggtttttgtatgagacaccatgcaagatcctaggataacagcatcacttattttatattgtagtaaaacatgtaacgtaaaatttaacattttaaccattttaaagggttcagctttctggcattaagtacattcgcgttgctgtgcaagctatcattttttttttcctagtgaatatttagatataaatcacaatccctttccagtgtctccttttttcttaggggataatgattgataatatgattaaaatgaacacataggcagtgtatccactctgtctttcatagcctagtgttcttatgtacattctattttagccatctcttgcacacacagtagtgcacatgcaacccagccacacatacacagtcactgagtgtgttgaatcactgtccttcccactctcctagcattttttcttcatattttagagacatattttttcttctcttttttcctttactctcctagtatttttattttaaatttctcatactttctctttaaatttgtggagcaaaacaaaaaataaacaacaagaaactgtgcttaacgggaatgttccaaatgttctcagtttatggcacccttagtatctcagtaattttattttcaagatcctctaggccaaaagatgtacctcacagtttcatttaattaacataatatgtttaagtcctaacaacttagtagccttttgaaaaaatgatacacataaattgaaagcaaatctatttttattttatgcttagaaacccacaatcacttactaatgggatttttgcctgttgaatactgcccagccctcaaaccttgaagtcacactggacgctatcattcttatttcctttaatttttttatggaaacaaggtttttgtcattcttacttcatgttgattttcatgcagtatttgcttttatatcacaaacaaaatcaaaacccaactttgcaaagctgtaacatcattgaaaggaatgtagcatgatctaatattgaaactgcaaaccactttaatagtttttgtgctgcctaatggatactgctgtgggttttttgtttttgtttttgttttcatatattgaaaacattttggccaggcacggtggcttatgcctgtaatcccagcactttgagaggccaaggtgggtggattgcttgagttcaggagtttgagaccagcctggggaacatggtgaaactccatctctacaaaaaatacaaaacttagtcaggcatagtggttcacgcttgtagttccagctactacggaggctgaggtgggaggaccgattgagcctgggaggttgaggctgtagtgagccatgatcacacccctgcactcccgactaggtgacagagtgagaccctgtctcaaaaaaaagaaaagaaaagaaaaagaaaacatttcaccattcccctgagagtttacagtggtgccctggaccaccatgacagttagagagttgttggctttatagccaaaaaataatatttgtatccaagtaaaataatgtcattagttggaagtcaagatagatatactaaaggcattaatcttaaatgtccttcataatttcctcagatacttaaaaaaaaatctccacagatgtatcaacctatcatttcgttattgtaggacaaagtttacttttcttaaacacctgcccttaggattaaaaatcaactatttcatattcagttgtattttctgtggtttactagtattttctttgtcttattttatactgttcttttcagtaaataactagttttaggctaatttagtttttgggcttagcataggagtctaataatgaaacatttctaacatgtagaagaacatatgctgttttctatccagttaactcacaaacatacttctagaacctaacttgctttttaattagagactgccatagatgctccctgtggcgagttgagtctcttttgtcattttgaagtggttttgtttactatctgttcaagagacaggctgactttggcacaaaagtttgtttttgtccctggtttaccttctttatacttccatttgacaacatgcttttctgcatatttacttctcagcatattttagtagcaaggcttaggtgcaagagaccactggaaagattgatcgtttaccactggaattgtcttatttgaactttgctacctttagcaaaggtttggactgattgtcgacccaggactaaaaatcttcagattctctgtgcatattaaatcagattaaagacctgtgtcagtctgtgcagactgttctaacaaacataaaagaacagaaatttatttttcccagttctggaagcagtgaagttcaagatcaaggcagcagcagattggttttgctgaggtcctgcttcctgttttttcctccgccttcatatggcaggcagaaggtgtaagagcgctctctgtgatctcttgtataaaggcacagtccactttttatatttctgggatctcttttataggggcagtaatcaccttccaaaggccccacctccaaatatcacattgggggattaggatctcaacatatgaatttggggtggtggggacactagcattcagtctatggcaggatcaaaatgcctgagttttattatttttgattaaacatctcttaagagcaatggtagtatattaagaacagaatgtgctaaaaattctttttggttggttgttttagaatataaacataggacttctactttaaataagtataaaataaaaataggacctaattttggcatttaatatatatttttttcaataaaatgtagaacgtatttttaagtttaaagttgtattatacataaccgtcacgtattgtaaatggatgtgtttcagtcagtgcattttatggagtgaggaacaagtcacttctgattttatcttcctccttagtgaaagaaaaagccagattgttcaactgatttaacttactgggtatttttcttttcttcttttagattttattgatctaatccaaagtatcttataacttctggctggaattaaggtcagtactatatttgtgtcaatcatgaataaactgtgaaataaaataaaggcatcatgggtctttagatagctgtgtcagaaatatgcttgcaatgtgtagtagaagctcaaatttagtaaaaactggatatatttcggagttggcctactagcaaacatggttccctaagtactgtttttctaattagtataatttatttggtttttgaatgttgaatttatttaatcttactactacctgagtttcgaataatgaaaaaaatccaactcgaattcatttgtttaattaacagaaatattaaaagagtgacttcttggaaggctgacctttcaaagaatggtcagcttcctgaatttgcaggaaaacactttgaattccacaattatatactcatagagaatatatttcgtaaagagggtagaattgaaaacgtacttttcaataaaaaatttcagttagcagagtgttaagatgtcattccttttgttctgtgctttcattaattggccttaattgagactcgaaactagcttaactgagtttagagtagtaacagaacctcagaaggccctcacagcaataaacttgggattttatttatgccttctattttttttcaacatgtattcagattgaaaaaaaaaacactaaacactgaatgaaatgaagacttttattgcttatgaaagaacaacatgccagttgttgctaaactttttgtataggcttttgattaataattaacataaaggaaaacattggcttttcatttgcccttacactaatcaggaattttccctttaaagcccatgtttaacccttcagattgcagtgtctgtcatataacaggcacactgtaaatatgtaccttttctgacctcactttcctacaaccaaatacatataagcacacagacacacagacacactctctctgtcccacacacacacacacacacacacacacagagatgaaaaactactattatttctcttttcaggttcaaactgtgctttcctatcttcgaaatctgtatcgaatgaagcaaatagaatatattaaaattatgcctatagataattggaaacttaataaagaaaaaaggtgaaatgtctacaagtattggtttcaagtctataaactgtattattttattaagtgtttttatatagttcggggtcaaatttattaaagtttctcttttttattcacttctgcatatgctatggagatttgtgaacatttaaatgtgcaattttttaagattttttgaatttttttctacttttatcccctactagcccctatcccatccacctacaaaaccaaaattacaagtagaatgagatttttgtaaagtatacatcattgaatcagtaatattttcaatgcacagagttaagttttaattataaataaatctgtatgagaggtaaacttttcctttctcttctttaataagaaataaactcttcccttcctgatttttttattttatagtttatatggtaaacatgacaatttgcaatctcatcttgctctgaccacttaccagaatgaaagaaaactgaaaagaaaaaagatttttgttagactataaaaaactaacagtaacgcacaaaaatttttcataatctgatcccctaaccatcttccacatggagatttctgttgtgggaatacgaaaatcgagtgtgtttggtcaagatgacttgcctattttcaaataaataaataaatatatcagtgaaaataacgtgtacatataaatggaaacatgtttaagcctctcttattaccaggtcttcccacttggatatgtgtggtttagtatttattagtattgttttcccttctatctggaaatgaaaataatattaaattacatttggttaatcagttatctaaatcacattttgtaaaagcagttagatgtagtaagtctcttaaaactatattaactcactagaaacagccaagttatcaaaacagaatatatgtaatggaaattaccatttttttcaactataactaagttacttttggtttaaaataaaagagtttccctcacagaaaaagcatgtttatctgtaaaactgttagctgagcaaaataactagtgttgccagataaaagaaagctaccgataggggtatataaaataggacatcagaaatgccattgcaatattttatcaattctgtgatgcatgtaattttacattaagttatgtaaaattaagtgatgctatagttaaattgacagcattttttttcctagtggtaaatgaggtatgtcttgtaatgaatagcatcttagattttatgaaacacaatattactgaatttagactggaaacgtgttttaatctcctaaagttattacaaaaaaaaaaaaagtcagaatgaaatctagaaacaaggaaggtaaatttggcattgattctcagcaacattttaggccacaatttttgcctttttaaaaaaatgtgtattggtttttctgatctacttctttttctttattattaatactgctaccagcattttggtatattttcctccagttttttttgtggtttgttttcacaaaagttaaattaaattttctattctatacattgcagttacttgaaaaggtgatttttaatggctctgtgatatactatcctatggatatttcatagtttatttcaccatttactcattgttggacatgcagaccatttttaatatctcactattataaatagccctgcaataaatatgcttctaaaatgtttatgttcactgctgacattgtacttaggatcaatttgtagaagtgggattatgtagtgtaaagaaataaatatatttgaggtgagtaacgtgtacattatgttccccaaaattatataccaatatacacttcactggtagcagaagcagtctgagatttgcaatacccatgccaatgttggaattaggattttaaaaatttctctcagtttgataagcaaatgatggattctcaattttagaatataaaataggaaacagatgcttgtaaaggaatactcatggatcattaaaaatatcaatctaaacagcataacttgtttttagatagaatgacgaggtaatgttaatttcattggctctgccactctcagcctgggaaggctatttgatcttatgctgttgaagacggaatcaaaagctaaatgattttcattcttataaagatagatgatcatgttaattatattaattatagttttcttgagaaagaggttgaggaccctaaggaatgggacaagggagacattctttaatagagttctcaagtttacttacagtggaggtactgctcaacaagtgacatgaggtgcagtagcttttctggaagtgtttggaatgctgtgagcagaaaagaactaagattactctacaaatctaaaagtgaaatgtcatattgtgtgctagctagtgtagatattttataaatttctctcctcaaaatttaaaaaatacatttctatattgatactgtcttttagtctcattttgcaaaatcaaaagttaaaaagaaaatattggatataacttgttgctattttgtatccgtttcttcttcatcctatacactaaccttttatccttcctctaatgcagtcagtacttagcatatatattccatgaagaccctacctccaaccctatcctatcttgctcccaaagagggatcatgttcatcatactgacacctagttctaagggatacattgcttaacacaaggctctcagtgctataagacttcccctgcctttgcaattgcacttgactatattaaagtgttctggtggcattggttgaagcacccgagtttgaaattagattaattcatgctttcttggtgcttagaattcttaaacagatgatttcctatgattttttttgaagagatggagtctccctctgtcacccaggctggagtatagtgacacaatcatggctcactgcagcctcaacccttgggctcaagttgtcctctcatctcagcctcctgattagcttaggagtacaggtgtgtgccaccattcctggctatattttttattttttgtagagactgagtctcgctttgttgcccaggcttgtctcaaactcctggcttaaagcgatcctcctgcttcagcctctgaaggtgctaggattacaggcatgagtcactgtgcctggtcaattacctatgactgaatcattaatatttatctgaaattatttacccaagccctgattttgatccagtgctccagaacagggtggatgttgtgcttcttttctacctggatctagtccttcctcctaattctaatcttttcctctggcttaacctctgatgccctctatacttctagactgctaagctgcttgtggtattccttggtcaagccctctgattttattatctgtaaaatggaaacaaaaataacttatacttcatttcaagattaaatgagatattattatgagtcttaaaaattgtaacttttagtccacttttaagccctctatcaaaatatgctaattactttgattattacatattgtatacttgtatcaaaacaccaccttgtgtctgataaatatgtaaattataataaataaattacattttaatgcaaaaaaagactcttagaacaatgtctggcatatggggattgctaaataaataggagtgtttgttccattgatccttgaaaacaaacaaacaaacaaattctctattaaagtctttttttctagattttacatgtgtaataaattctgacgcttctcttaaaacagaaaataaaatgaatgaggatctttaaattattgttataaaagcttcaaaatatattaatgaaagaagccagaagttatacacacacacacacacacacacacacacacacacacacacacacaaacacatatatatataaaatgtatgatatatataaatttaaaaaatatttcttttatagagatagggcctcactctgttgcccggactggaatggagtggtacaatcatagcttagtataaactcagacttctaagctcaagtgattctcctgcctcagcctcctgagtagctaggactgtggtagcatgcaccagcacacccagctaattttttattttatgccttttatacagacagggtctctctatgttgcccaggctggtcttgatctgacatgaagtgaccctcctgccttggctttccaaagtgatgagattacaggcatgagacactgcacgcagtccaatttatagaattttatactgtattttaaactggccagaaagtaatttctctatgctctgttgagtagtattatatggttcattaaagatgctgttaaactaaacagcatattgcacaattaagcagacttgcacttaaaaaaagtgtagaaaatgctaatactctaatgaaataggaagtggggagaggcggatgttcttaatgtctaaccagtaagcttcagtgctttgagctttccagaatcaagacaaaattttgattagcttcttggtcaacttccagtaccttctcagggagacgctatatttctcttccaacttgcttcatgttgcttcacacatttcttatagacttgttatgcttcatgttatgattgtatctggataggtccattctcccctagcagcccataggctttttaaggagaaactggggcctttacacttatgcgtgctgtctcaatagggccttggaggaaatggacacttaggaaatgcttatataatgaattttaaagacattcattatataacaaacaattataaaattgcaaaacagaatataaacaattgtattacatatgaagactatagagctacatatatgtgcgtatatgtgtgtatgttttaataatcattaatcactgtatcctctctcggccccctatctttctctcttgaaaaaacaaaaaacaaaaaaacaccacagatccaatacttgttctttaagattcttccagtgggtagtatttttgtattcatctttcatggcatcaacaagcctatttcctcaggatgtcaggctgtcaaaatgaaagcaattctggaagcacgtatccccaagattcttcattaggtcatgtgaacaaatgaggagggatagcaagtttgtctgccatcctcacttcaaccccctccccacctctcctcttctaaattatgtcatgagctaattctttgatagtcacgtttttgtccaaaatctaggaaatgattaccattaaaaggaaaaaatacatatttatgatgcatcaaatttcagaaagcttcacaagagaaagtaaattatcctaaggattaaatggtcttttcagtttgaaatgtgattctggaagccttgtatttctccttaaagtagtaaacaaataattggccattctataaatctttccagaatctcaaagtcactttgtatcatatgtaaatctaatcattagaatcctggatatgtttttttaatacaaagatattaatatactatgctaaatgtaggaataaaataaaatgacaaaataatcacctttttcataagttttctaagtttcccaaattaaacctaataattattgcagcttcaaatgtctttggggtgattattgtttaaagtcctccctttttttttcatgtgggaaaagaatgctctagctcattctttattccttaattaaatgtagtatcaaatggctgcaaaagacaaccactggctatgttttcatacaaaccccatgcttatgaaatcagttctgtggatttaattcactgaccagctaatctttattcttttcctaaattcatctgtaaaaaagaatcccattccaaagaataacacagctgatctctttgcagcccatttatgtcattaaaaagtattataacctaaatataggccttatatcttattagggtagtttggaagatttaaaaataaaattaatgaatttctttattatgtaagaaattctttatattctacttattgcagaataagaactgcatagtagtacaagggataaactctcttgttcctctataaatcaacgtgagacttgttaagcttcatcagttattcacctgagaatagaaaagtatccattgtgtattagaaaaaggaatatgacatacaatacacacatgtgatagatagataaatggatagtcatgatggtttcaaataattttgccaatgcacaatacaagggctttacttttaggaatgccttctgagtcattcatgttgaagagggtaaaattatgtgccttttctgaactaaactctcccagttattaataatataaaaatgttagttgaaaaatcatttgccataacaaaccgacatggattaggtttcattccatattattcagtgtcttacggttatcaactttgtgttgctttacagtcttcattttctttctttcgaccatttcaaatctaattagtgaagagttgagtaaagaaaacactgaatgcattatatgagtacatctgtgtctatcttctttctctctctcatttatctaaagttttatacctgccaaagtttgtagttcaaaactagagcaagtgatcacttagtacattactttttgaatattaataagtgtattagtccattttcacactgctatgaagaactttcctgaagttgggtaatttataaggaaaagaggtttaattgacttacagttctgcatggctggggaggccccaggaaacacaatcatggtgcaagcggaagcaggcactttcttcaccttcttcacaaggtggcaggagggagtatgtgcgagcacgatgaagtgcctcactttaaaaccatcagctcttatgagaactcactcactatcatgaaaacagcatgggagaaaccgcgcccatgattcaatgacctcccacctggtccctcccctgacatgtggagattaaaatttgaggtaagatttgggtggggacacagaggcaaaccatatcagtaggtatttggaactttaagtactattgtcttcattttatgaatcgagaaacttagtcattaaaccagaaacaatttttatttttatttcatttatttatgtagagacagagtcttattctgtcacccaggctaaagtacagtagtgtgatcatggctcactgcagccttaacctacccagctcaagtgatccttcttgccttagactcctgagtagctggggccacaggtgcacaccactatgccaagctaaattttttttcttttattttttgcaaagatggggtctcattatgttgcctaggctggtctcaagctcctgggctcacgcaatcctcccacctcagcctctcaaagtgctgagattacaggcgtgagccactgcacctggcccggatagaatgtttataaacagagtattcctctgtgaagtatgttagttcttagaaatacagaaaagtctcttatggaataacagtaagtagaaaaatacacatttatctaaatgtaactacttgcctatgatatacatcatttagtgatggcttaaactataagatattgatcttcagaatgataaagagagtgggcttgatgtcatttgcttaaagatgcttcacctagaatgaatatactttttccaccttttcctcaaaactattgccttctattagtgttctgtcagaagtagctctctggtacaatactaaggtgcaagtataagctgatctactttttaaaaaacagctacggtggcatctttaaggggttttaagtcagccataaggagtattagaccaatagaggagaatcagttaaacaacaggaataaaaaaagggaagggttaaggaacttaccgaaaataaaggtataggaatttcttcctttaaaatttatttaaattttggaaatatggggtaaaaatgagtcagtgagcaggacgtttaacttgacaggcaactttatagttgcaaaccattttaaatttcacttcgactttccattatcccttagagactcgaagacctaatttagactgtctggctacactatcacagggggatgatttgtgcacttagggtatcccttggggttttctacctgtttggaaattaagatgtaaattagtattgtagtatgttagaggggtgtactggcaggcagttaatttccttaggtgaaattaatgctcagagagaaatcgtacttacatattcaggttaggctattacataggcacttcaatggagtgaaattaccttttcttctatttcatacaagtgttgtacaacacaaaaattacataatcttccatgttaataattactaatgtcaccttaaaatattgtatgctattgaatgattatgcatttactggaaatgtataccccacagggtatttaccaagtttctctatcaggcatcatcctccctcttccgccatacctggaactgctgtgttcctctttcactgtagggactaagtagatatgtattaatttttggattttcttatatttagatagtttttgaaaattttctttttggtgatcactgaagttctctgttagagacctagtggcaaaagttattttaactttgtgcttagaaaataaggacactcttcacttttacataaatataaagaggatgcaaacatcaagtacttcattaattaacaagaaaacttttagaaatatcatgtgttttgtcaccacaatgtgtggcacaatgccagcagatggcataaaaagtgtttgaaacgtgatgtgatttggttttgctttcagaaaactaaacagtttctctttggattgagcatagtatcttcttcatgtacatgtcatggattgcttagatagtttttacaagttcgttatctatctcgtaaagcccacattattgtagtttttgatacgtatctctttatttcatcattttgacatagccataaatggtatcccacatagatattcaaacaatgtaccattaactaggacatagaaatcctagtcattagctaacatgaccccacgtggaaatacaccactttatggagtggaagggcaagggaagcagatgggggaagaagtatgctcaaaaaatagaaaagtatatacaaagaaatacaagccatgaggtgaatgataaccaaacagattttttttttaaataagagaaaaaacaaaaagtaaaacagcctagatgataacacatttttgcctggtccagcctttgggaaaccagattacattctttcatctcatagtttcatgggcatgtatttttaccagggaaagagaatttgtacatgataatatttctaaatcatactctaaatcattctctgtactttcagaattaaatcttggcacacatgtagtaagcctacatgagaaggtgcagttccaatacaactgagtggttattattaaatcaagtagtgaagatccagttgtagttcatttgagagcaagattctgtgaatgctttaaatgtattaacagtggttactttgctctgcaatggcttacagtcaagagaggggaaaactaatgcatataaatattaatacatgatgatacaatcaaatactaagcacagatataactttgtagagtgacctagagaagatataattgattttgaagggctgaattttttaaaagggatcttcagctgggtttataggtaaatagaatttatatagccacaatagagagttagaggtacagaaagaaggacatttcttgaaaggggtctatggaaaccaaagcacgcataagggaatgaggactcagaagttgagaaacctgaacagagggtgcgggacagttttactttggatctgtattctgcctcttcttttcttccttctttcttagtcttccactttttttccctacaaatatttgttgaattacttgtatgtgtatctgttctttaactgtaagcagaaacccagttcatcatgagatttttcattctctcttcatgcacacagaatagttacatagatatatactgctgtgaatgtctgtttcaaaagctcactttaatgaaagtctgtttttgtcgtaggttttatgaaaagaaaaaaataaacattgatatctgaacacatgggaactagatgttccaactcaccctcttgatgtctgtaattattttattttggcactaatattaccaagcttgtttataattaaagataaatgaaatagtaaaattaactactttatctccttatttaaatttcagatgggaaatttggaattttactgtttaagtcctttgttaaatatctaaaagggctctactacagggagacggattaattaaaatcaaaattgttgagggaatataattaaaaacaaaatcttataccaacccagaaatcccctccaccaaagtaatagaaaaagaaaacacttttactattaagcattaaaccagaatgtgatgaacattacaggcaatccactaagattataaaaaccaaaagaaatctcacttttctatattgccaagtagatgtagccaagagtgggattacacacatgctttcaagataaacaacaaccagtcctcaagtaaaaggacttgacagccccatcctaaattcttcaggtaattggggtgatcatctgtgttagctaattggctttctctgaggagaaacaaatttctcatccctttatgacaggaagaagttttgcaacttggagcaagggtaaccctgaagttaggctcctaccctcccataggaactgggagataggggagctttctcccttgatgtttgcatttcaaaaagatagcctcaaggttcttgagaaagcatttctgagttgtgaggctaatgggaggcttagttagccatcattaagatttacataaattctcaaagaacaaagaaagaaattctaaaagaaaagggagggtagaaagcagtctctatctacccttgttttcagcagagagatttgaataagaggtatatttgtccttacagtgtaaaatgaaggaaataattgttttttaagaaaagtagtcagtggatattttgggttacctgagtatattgtcagtatattctaaaacaaataacaaataggccttaaaatggaaagattgaagtaagatgatcactactccttcacactcatagtaacttgattgttgggtaaattattggagggtagttctgctcatatttggcttttgcaagggaaggcagaccttgtggagagcagaatggatcatataaaaaaggtcttaaatttctacttgaaatgtgtttcagactggacatcctagctttctggtgcatttaacttaaactgctcaactactcattcagtgctcattcaaatgttaatgtgggccatctgcctccccatccccatccttttttatagcaggaacaagctgaaggtcacatgaccctaattactgcaattatgagatttctgggagtaatcacttaggttgcacccagagtgagcatctgctgatgataaatagatcaggagattactaaagacaggcttccctataagatatccagtgattaatttcttaatatatatacatatgcacagctaaatccatatgctctaataaaagcattcttttcctcacactttttcctaaaatgcctctttaaaatttagtaggaacagcataaaatgcatatttttttgtgtgcgaatgtaattagaattctaaagagggaatagggaagatattctaataatgactaataatgaagcagcagcctttacctacacaaattttagttctctgtgcaaggagaaaagaatgtcacaagggcttaatctttccagcagaaatattatttcatattattttattttgttttgtttttattaattttgagatgaagacctaatttctaatgaaaagggtgtgtgtttaagggaagattcttcaggccgcttaagaccttctgaggcccattccttagcaagatgaattcttttccctttcatgaggtcatttgcttattaaaaggtggttgtttcataggatattttctcacagtattgtttactttgctccctattatattttgcttactataaagcacttacagttttaaattctattgtgtattaatttgacttatttttagcctctcccatctcatgcagtaatttttgaatgacacactgtgctaaatatcatgttaggagatgtggcagtatttttgcaataccattggttggtctccccatgttggttaatgacaatgacattaaaggttatgcatagtatctttcttcttttgaaaatctctccttttgccaatttgcccccaaagtatggtttagagcttcttataatttcctttatagtattgaggcaggctaagcttatttccagtatgtgtaaaatgactctaaatgaataatttattcactaaacaaatgctttcttgagcaccacatcgtgccaagaagtgtgctagaaaagaacaagaaagacacagtcttgctcacttttattcaggtggcagcagccttctacgtacatacatgtactttacaacacactaatatgatgcaccaaaatataatgtatcatttcctaaatgatttgacctcatttattaataatttcaaaatacatcaattgatggtttttaaaagtcgttttgtggcagcacctgtccaatccttcctcccccaccccctcttttgtcattactaggatatgattcaacttattcttcaggcataaaggagtttgattggattgtaacccttttctctcctttttatctgtgtttatgcttccttccttgcttcttgtaaactctttaatcttatttaaaaaaaaaaaattttttaggttgttaggactgatatctttctcttctaacttttcagagaaagaacagttaagagactttgcaatattggaactctgtcagctgggcccctatgcctctcaaagataacatcaaaagcacattcatgatccatctgagctgatataccaggagattgggattttgtgatcaataacacattatatggtccattctatagcatgttttaaaggagaaactgtttgctaaattccttaattgttgttttcataggtactaaagctcctatggtattattttttcaataaaattataaatacatagcagtgtagttcagttcagttttgtaagacttcatattaattaaatcataaattacacagaaaaatcttttgacaagccatatttttagagctttggttcagaaagtattgttttcataaataaaattcaaatgagggagaatttgttcattcacttttaaagaagcatcaaagacctgtgtcgagctgcttctcatactggatatagaacaagagtcagcatcatttaaaccagtgccccattaggattgatgggcctccttttttttttccaccagctagatctcagctgtgaaatgagaaaaatatattcagtaaagacagtaatataaattccaaggagctaatcagattagaaagccatggccatacacttctgaatcaaggcagagccctgtaaatatggctaatgcaaaaccaatggcacctgtcacaaaacagcattttgaactctaaaaactagagtatcatagatgcaggaaaataaaatgatttggaagaagtcttgcaggttgggataagagagacctaaatcatattgaagtagttgacaagtcataaacctcaggttgaggaaaatattgccccttcttatatgatgtttcaagaaatgtttgtgacaaataatttttaaaaataacttttgaaagtgctgtataatcaagcattgtatttctgattgagagttcaaatccatatatgaaaaaagtttcaaaataattaatatatgtaagaggcctgcacttgtaggtctctgcagttgtaaggacgtggcctaagacctcaatccaggaaatttatttaaagctccatatggaagtttttgtttttgtttttgtttatttacctttggtaaaatcttaaattttcttcattcagggaaagtatcagttgatgctgctccctcagtaacaaaacggttgcattcaaactgttacaacttacatagaaaacccagagcactgaatcaaagagatgtcaactaactcattgaagcccacaattattggtggtggagtaagtgtagttgtgactctaataaatttacagttgtcttttcctgtttatggttgccaatattggtctttagatatgatgtattacatacttaaaaacctggtaagggacaaattaaaatctgacatttgcattcagcttaaattagttaagtcagtaaatggttcttcagccttatttcctgccatctctcctccttttattctccatgtttttttctgttaggagtgaatgcttagacctcagttactcagagccgtctttcctacagtgggcgagatgccctcactgtgcactcccataacaccccgaatgcaatctctcatggcatttcgctttattctccctccctaatcaacatgttttaaagattaattagattcctagttgttgaagtcagagaccacacatggcttgtcattactgtctttctggaacttagtgcgttgcttgatataattttagtgtttatgatgttgcccacattcactcttactctcattgctgttgttggattgctgttactattccagcgccctgtgtgcccttctctattgctgtcctgagtattccctttctaaccaccctgtctgagctcctcagcctacgtcttctgcatgctggaggctggacccaaatgctaggcccttctcttgcccatctcttccagcctgcaggagctgctgcttctccactggaggctcctgtcgtaattcagcagtcaaactgcaatatttacttttaaggagcttgacaggtaaaaagaaatctcttcaaactgcatgagacctattcagctccatttggctttttattcatttatttttctcttgccaggtggtccgaatcaaagattgaagtgccctagatttccaaatttgtcttttatatattcagtgttaagtgcttagtgttgtttataatttaaacataacttttataaaactctattttgaaaagcgatgactaactatggatatacataaaaaggatgttagcagaaatgaaaagttccgtttaagtccttcttaaggcttgtctcatttagacaaacaaaagttacattgtttgcctgctcactgatgactggtaccatttttacttcccccatttgctaaatactcaaaatttatttgagcttttttttttattaaatgcagcgaaacaatttagtgcatcaaaaactacatattgtggtatgagtaaatgttgtttcacagcttattttagcattctagaaaggttggcatggaaaccttgagaaggcattttagatgctcagtgatgcataaaggcattcattttgaaagtcctgtttatcttatttatcccaatttagaatcaattttaatagttatttgtatctaattttagaaatatgatttttttcaacaggcagaagtagtttctttagtctttttcttttttttcttttttttatttttaacacacataatccagagtcagggagagttttcaacaattaagcaatataattcactggatagagatatacattggaatcatttagatttggtttcaaatgctggctgttagctttatgataattgctatgttagtagcctcgaaacatgagattaaacattaagataatagcaataaaaggaaataaataaggtaatacatgcaatacactatacaatataatatgttaccaggtaatatatgtaacacacttgcataaagtatacattcatcaactttcattattatatgtgtaaaataatagagctggaaaaagaaaaattcaataaattactttgactcaggaaccttttcatcattcatcctcttttcagtctttctgtcttgcctgaacactgggaaatgttggttcaattgaatcacaagacattcactaatttatttatgaataagcttctatggattacaaagggtgtgaaaaaagttaatatcaatttttttttcaattcattacctgttgtgtttgttatttggttgttggtggatctctcttaccccatgataattagggaccatcagtgtcccttgggatccagagacctggtttcaatttttgtctcgtctgctaagcagctgtgttaccttgaataaggaaattcaaatcttgagacctgggttttcttgtatataaattaaatggagatgagccgtattatttttaatatacgttctagcttttatccatatttttccagtaggatattagaaattaaataaagactattctgtatctaccatctctgtagacatgctcagaggttgtcaaacattttggaaatgacttttgttaagtgaattagctactaatttttttaaaacttagagtcacaaaacaactagcaaataaatgacaattatttctaaatttgtttttaatatagagattaatttttcatatctatatttagaaatgacgtcttctaattttatctaggcataaaacagctaaaaaacttgatatagtctataccaaaataacccaataataaaagtaagttgtaatgggagaataacccaaaggagcaattttcatgtgaaaaattttccagtgtatgaagaattgttattcacggaaggctaatctgttggcaatgtctgttgctgagctgaagagggttctgacaaagcaagcccattcctgcatggactaagccttcgagtggccttgaattagaaaggaagataattctgcctctggaaaaagatatcatagtgtagttatatagaaattactcctcaaaagttccaacccttctaactaaagctttaccaaaagaatcccaaagaagataaactttcaaaattccgctaaataaaaactccattgtcctttcaaaaaacatatacattctcagggaattttgtatagttcaagattatataaataactttgtccaaactcttagtttctacatttctttagaatttctctttttctcctaagaaagtctggggaaaaaactcttcactatagtaactgattagttccatttcctgtcatatttcttttcttgtggttgctggtttctagccaattctatttttgcatttattttcccccattacattctgtttcttttttttctgggtagaagaatttttgtgtttttcattttgtcaaaatggaattcttctcatgttatgtcatgattttgatattttcaagcttaaaaagcaacacagaggaggtttgtttacataatgaagcatatcatgggctttttacagaaggtctgataattcagaaagtattttcaactagcagtggattagcaatgcctacttttttcataagtcctattcttttgagcatagtcagcttgaggcagctgtggtttaaaagaggaaactaggagtctaggaagtgacctcatgaaaatgcagaaaattaagagtttaaatagtaataatatacaaaagcaaatagcatatttcactaaatgtctgagtgcctgagaattctggaagtggagggaaatccaatttaaagaatataaaattaatatccacatgtgagtacatagagagaaatacagaagggggaggctgagagacctttctcaggctttcgttttttggtttgtttctttatttttttctttcttttttttttaaagagcactctagatttatttgggtaaaatacgtgagtatttgcttaggatatatgcatttataaatttaaaagagcaaggattctccctggggcaaatctttccttggatcattgaaaactaaccaaacagtgtcttctaactagattatcttcatactagatccttgcagaagtattagctgacctaagtcctattttttgccaccctgaaagtgaaagaaggaagtgctgctataataagaactgtaactaaatctaacggcatccctgttttctgatgatggtcatgtgttagaaaagtttcatttcatacctgagatataagatgtacaaatgtctttcctaagcttgatcatccatggcagatctatgatggaatatagtggggaatctgtaaagctgactgactacaaaaccaacaaatactttttcttctctcccagatttacttaattaaaccaggagacttgtgaatatatgaataggacagagctccaggcagatggacttttatgaattctgcaccctcactatctggagctctttatactaatcctggcatctgggagaaaagtgattgcaaagttacacattagaattgtctcattttcttgtggcagttcttagtgtgatatctggtggacatcgttcctgtatcaccctgtgtagaaataaaaaagaacacttaatcctcacttactctaccctgtatttttctccatagcatttctatattactgatatatctgatatatttttttgtacaattaattattgtttcacctaactagaatgttcatagagcaggaacattttctgttttgatcactgatgagtccctaacatctagccaagtttttggcacatcatagttgctcaataatatctgttcaatgaatatgaatttagtcactattttcacgcatacaccgatgcctactgttgtctggtcttcccctcgcagccgtgtactccgcctctcttctttctcaccacatcccacaattcccatcccactagcagctttcttcacaacaatgaggttacatacttgattaaggaaccatctcttatggatctttctcaggtgcttagtgtgacaccatgtgtggctgtgccctcttagaggtgagagctgagctcctgatttggcttctttatgcccttccttcatgaaggacagtggttctcagagtgtcccctgaaccagcaccatcagcatcacatgggtacttgttagaaatgtaaatctttgggctccaccccagacctagtgaatcagaaatgtgtggctgcagctcggtaacctgcgttttgtcaagtcttccaagtaattctgatgctgaagtttgagaaccagtgagaagacatagattgcctcctggctttgtttttaacttttcaaaatccctgtaatttctctgggcatatttcttcaggagatccaaaaagattcatattatacgaagttctctctctaaattaatgcaggggcttaacatttatttattaaattatgggcatggtaggcatagattatatgtccctgtagaatcttgcaaggtagaagccatcttccccccctgcccaccccagaaaatatgcaaattcaagtttctagaagactgggctgtaattcccatttatttttaagtgtatacctacctccttcatccccccaaacttcccacatggtatatgtataaattcaaccctagaacctgttgtaggtgagccacagctcttcaggacaaatactcaaaatcagtaattgtatgtaaagctaaaaattaaacttctttagaatgggaaatattacgtagatattatatagtcttctttcttggaaattctatgtaattctgttttagagaaagataggaatggttcctcactttaaaatttttatgtactaaatctgctttaatttataaaatagcaatataatgttatatttgcttttttattaaaaccacttctgtcatttatgggaaaatatttcagttgccacatttcattcttaacttgattataatttggttaacatattgacagttcagccttttgaatgcttgacttctagtccccagacctttcactgtagctgaaagagcatcagaacttgggttctttctcaaaagaggacctggaagaatagctgagcccatgtcatcttaggactatatatatatacatgtatatgtacataaatatacatgtatatatgtacatatgtatgtatatatgtatatgtacatatgtatgtatatatgtacatgtacatatgtatgtatatatgtatatgtacatatgtatgtatatatatgtgtgtgtgtatatgtgtgtgtatatgtatatatgtgtgtatatacatatatatacacacatatatacacacatacatatatatacatacatatgtacatatacatatatcctcaatcattttttcacattttaaaaagcctaatcacatatctagcctttttctctggggaagaccaattcattatagttccttaagaactttgagtctgaactaagaataaggaggtgctatttgtctctcaaatggagtttgctatagtacacattagaactgacaaggattttagttaggaaaaaaaatggtggtgtggatgaagcagcaacagttatcaaatgtggtggagaggacactaaagcttccttgcttgcaatgttagagcaacaagggcattccattttgaaaggaagtaagcaagtttaggaagacaaactctattgttgtcaagattataaattagcaaggcattcagtcaaaaccgacttatagttaatgcattgtacgtcaattaacatgaataagtaaacttcttaacaaacaactgtatgtgtgatttgatgaagagatggtaactgaacctgtcagatgaggaacattgctgggtgtaagtgagaaaagcatatatctcctatggaaatcatcgatgttactgtttagtccattaaagcaactcttcaagaaaaaatatatgggtctgattatcacaaatgttacttattaacatatccagtcttataatgacaccaggtctcctaaaatccctttataattattctaaaaatagaattcaatctaaaataagtgggaggcaagcagattcatcattcactaaagggcatcagcaagatgaaaaatggtccatagagaagcaataaatactttgagcaaatacatatgtcactaagtacctataagctatttatttctcattttagccataacctttaattgtactcccatctgtcctagaccaattactcacgtcttgactgctgaagtcatttgttatagcccaacattttgttctttcttttctttcttcttccccacccgcccgcccattaatgattgtagaggagaaacaaactcaataattctatgagtattgagagcagagttttccttaggtatatttaattttgaccacatggggaagaattacaaaaaatttaaaataacagtaacttaagccaactcaagtttaacatagtgctccattatcatcagggacccagatgctctctgtatttttgccctgctgtcctcaacatgcaacttccattttgtttccaagatggctgcttctgcccccactgtcttatcacatatgcatcccagatagcaggagggagaaatgcagagatgggcatgacctctccctttacacacatttctgactagtcacatatacttcttgttctcacatcccaccagaccttagttatttcatcgtactttgctatatagatgatatgtagtcattattaaaaataaacatgtgcccaactaacatttgaggattcttttacttaagaagaaggagagaattgataatgaaggacagtttttggcttctgctgcatgagaattagccctatttattttgttaatcagaggaggaagtacagattattagggttgcagtgaatgttcactgttcagttacatgattataggacaaatatagacaggaaattaaaatctcttgcagattatttaatttgagattttaaagttgtctgctattcatgaggatgtgtatttttctcagcttgaattaaatcataaattctagtaatttgtatttataagagaacaaatatttatgaagttcctggcagcatacaaggttcttgatatatattttcatttttttctttataagcatccagtaatagaggtattcaccttttttatggttgaagagtctgagaattagaattgattaatttgctccaggtcacatagataataacaaatagggttgaattttgacccatgtctgttgggttgcaaaatgtgtcttttctcccatattgttctgtttcctagttgcttctcagtatttattagcacagtattcaatttgtttcattcatctttagatcctccatgttacaaacagtatatttagctgctgattgaatgaatgaaatacaaatacaaagtccactattttcgccaatgctgtgaaatgtttttatcatttgtagactatttaaagccatctcatgcctttgctatgtttaatttctgattagtggccaacatttttattgagcaaattcagtgacatgatagatgggatattccaaatagtattttttcttcataagaaaaaagaaagagaaaaagaaatgaaagaggaaagaaaagataatgtccttctctttatttctaagttcttattgcacctgactgtcctcatgttgtgggcttgttttgtctgtattccatgtcgtcaaatatctactctttatcatgcagaaatttttcctcattatttaatagcatagccttctaaagccatttaatttgagaaagcatgtgtaatgccatttagtggttattacatttgattgctagagtagagaaaatacaaacactttttttatgagcctgaatcagactttcataaaacaagttataaaataattaaatgtgtgtttgccaaatttatgcatgtcaactttgagaataatgagtcagaagttgaggaaaatttaccttcaatacccttgagttatttaatctttggctaatatgacttatttgtctgtgtactttacaatagttttagaaatctgttatgttaattgaattttgaaattcaaataatgatgtttgtaatatatagattgctgatataagctacttttacaggcaattcctctttctatttttaatgtgaaatttaagtgagcttaattattcaggtacaaatggtattgggcattgaccaaattagggtgctcttatgcaaccaatcttagactcctaagggaaggatcttattgagaaaaggtgtctttaaataatgttttctaaaatactataatataaatgttgatttgtttcctcactttgactaactagaaaataggacttcagctaggcatggtggctcacgcctgaaatcccagcactctgggaggctgaggtggcaggattgcgtgagtccaagattttgagaccagcttgggcaatatagtgagacctcatctctacaaaaactaaaaaaattagctaggcatggtagctgtgtttgtagtcccaactactcaggaggctgaagcaggaggatcacttgagtctgggaggtggaggctgcagtgagctgtgatagcatcactacacaccagcctaggtgacagagggagagccagtctcaggaaaaaaaaaaaaaaaaaagaagagaaggaggaagaaaaaaatgaaaatgaaaagaggacttcagctcttatatgttctaggatctatttatttcacataaactcttcttcatcatcctcattttctttatcacatgcctaatgctaagtgttaagcccttaccatgtgttatttcattgaatcctttagcagttccaaaaactaggtaatattgttatccctattttaaagatgatgtaactgagattgagtcaagttaaacaatttccccagggtctcatagcttacagctggctgggactggattcaagttgagacagtctgaaatccagtgcctgccctctaaagtatactatgatgcctatgtgcctaatctcacagattcctaaatgtggaactggccgtgtttcgatgaccctgcctttagtgttgtcccactaagtctctctctccttttaaagctggcctcttagaactcaagaccacaaaataacctcctgttcctctgcacagaaatcaatgtggactagttgtacaggctatttgcatttcccattttgatttaattggttgattattttaattagccaacaaatttgatgaatttttcaccagtgaactcagtggtgattttcatgtatcttaaaaactaggcttagcctgctctctggtgaactcatgaaatagctgggatttgcccactcctccctgctcccctgacagaagcattctccctttcagaccttttcttttttcttcaagtggtccgcactgcatttcccctttgtaccacttcaaaaccaagccttgaaaaataagtgcgattttactttctcattattcttctctactgcccccatttcccaagccaaggtatgtttttattatttttattttataatttatttttattttttatttttgagatggggtttcgctcatcacccaggctggagtgcaatggcatggtctcagctcactgcaacctccgcctcccaggttcaagcgattctcctgcctgagcctcccaagtagctgggattacaggcacccaccaccacatctggctaatttttgtatttttagtaaagatggggtttcaccctgttggccaggctggtctcgaattcctgacctcaggtgatccgcctgccttggcctcccaaaatgctgggattacaggcaagccatgtttttaaatattgttttttctggtttcctaattgctctgttttcagtacaaacattttagaaagtacagaacagtgtaaagaaacagaaagaaatacagatcccgtgattctacatccagatgcagctacagtatgcattttggcaaatttcctttcagccttttgttgtatgaaaaatttctaagacatgaggatttattttttaataggatacagctctttgaaacaaaagccatgtttatgctcaaggcatacttatgcttctggttcagatatacagaattgtctcgttctagggattcagtgaggatctaaatctgtttgtgttagggacatcgatgtgatgccaccctcaaagaggacaggagaggtgcttgaagatcaaaaccattcctgggagaactaggttgagacaggggtaaggggagccggtctaggtaagagagttgacaaagcaaaagataggtctttccatgaattttattaacacaaggagagtgagagcagggaccacacccagttggagggaatgggagttgagtgctggctgaaggaactagggcatcccaagagacctggcttcaaagggccgtccagcagcctggctaccccaaagggctatgcaaaataccaagacctgccaaagtgctcagaacctccaccttcaagcatagaccaacttgattattcctgagccctgcaagtaattgatgtgagaccttttgttagtttgccattaataacagccaacatttcttgagtatgtgtccagcactggctaatctatctcctggtgttatcttgtttagcccttacaacaagttggttactgttgggatatccattttacagataaagagtcagagttaagagaagttgatggttttgcccaaggccacttggataaatagagaaataggaattccagctcagtgattgtctcattctagttcttactcttcgctgccatgtggtctgtgatttagtcatttgccagggggttatggtagtagtctaacctactggaggaaactgttgtgtacgggggtgggtgggaggcagtaatttctggaggttttcaaattattgtaccaaggtagcattgcttaccccttctaaattgctctgtgtaaacctggtctataaatatgtcaaatattcaaactaacttctgacttagaagtattccaagctcttgagtctgtcaacattttttcttttaattaagctggacttcagttttattcacatagaacatagaattatataatcagaatatctcaattgtcacaatttctacaagagttacaattcaaaatttaactgaatcactgctctgaaatagcaggagttttaaagttagtctgcaaggacatgaagaaatactcatgaaacatgaaatttcaaggtcatgtaccctgcctgccatcatcccaaaaatggaatacgtgcattttttaacagctttattgggatataattcatataccatataattcactcatttgaattataaaatccagtggtttttagtatattaacagatatgtgcaccattgccacagtcaattttagaatattttcattacttcagaaagaaatcccatagtgtcctctggctactacctccccaccctttcatgtcctcccttctcctctctcccaccccagtctgaagcaactagtaatctactttctgtctctatagatttgtctattctggatatttatataaatggaatgatataatatgtgaacattggtgactggattctttcagctaacgtgttttcaagattcatccaagttgtgtcatgtgctcaatttgttctttgtattttattttttctaagggttcacacccttgatgccgataacaggtgcttccctacttatcctggacaacttcaccgcataaccataacatttccaaggatcacttagaattataaattttgcacattgtggtagacaggtctttgatccctgcaaagctttaagaacacttttcactacttcagagatgtccatgttctccttagcatcttttcgtctctcataaatatattttcagccatgaatgcatggttcagtgaagccttcccttgcagtctggcaaagtgtcttttttttttttttctgcagaagaaagctgatcaatggctgtgaaataaaagtaagctttaaaacaaacaattagaaaacagtagggtcaatccattttgaggaggtttgtagttttagactccattaataaattacaaagccagaattaaacttgtaataaataatactatgttgtaggtatttttcgaggtttatttttcagttacaccaaattaaatataatcatttgattaaaataatacaaaagccaatataatataaaattttatttatcatttgctgttcctcattgtcttctcctataagctgacctcttatataatatagtaactgaattggtattaaataggtctttgctccattcattgtagcttactgaataattatacaaatatttcataatacagttgtaaacctagaatgaattttatactaagaaacagaaagttaggttcttcaaaactttcttagaatgagacagattatggatacaaataaaataaaataaattggtattttaactattatgctttttatttcagcactatctcagagtgagacagcatttgtttaaatgtttgttaaatgtttattctcctaaacatttaataacctgatctgtgccataagctggactaggtgttttcaagtatatttcagttatttatgacatatgcaaatataaaataataagcaaaatgatgtaacactgtcatattattattattgttccagctatcagtatagtgcctaccaaagactgtacagatttatctctatgcttcattttgggcttgagcccaggtagagagaaaggtaaattttgctcagaaatgtatactgttacccagcttctttatactacaaatagcttgaaagaaaaaaagttttcttgactcttgttcagtcacagcagtcttccaaacaaaatgttgtttgttgaccttggaactgccctccacacaccacgcaactctttgtcagtcaagtgagagctgtttattgggtgctgtggaatccagcagcttctcacatggttccagagtccggtgaacagaagccttgtctgtgtcttgggtgatggtgagacaagacatggtggatccccaactatgattttaactaatagaatatgaagctatttcagagcctcactttgtgtcttaaattgagttacttgttaatctaaagaaattttaaaatatgatagtattttttttcataaacctgtgaaatgtctaagcactaagtggtcagacagaacataaatttaggtttatccaggacagaagttttcatcttcaccctttgtttcaatttccatcctattgggttgcatcgaaccagtgtttcctcactgaatatgttcattatgtgtgtacatactgtaaggatagctcacagtggcgggacatgtgttttataggatttttttctaagtggcccaagagtatacaggcatacctaattttgttgtgctttgctttattgtttttgctttattgtgcttcacagataatgcatgttttagacattgaaggtctgtggcacacttatattaagcaagtctgtcagcaccattttttcaacagcataagctcactttgtgtctctgtgtcacattttggtaattctcacgatatttcaaacttttaaattattttttgtatctgttatggtgatctgtgatcagtgatctttgatgttactatagtaattattttgagacccccaaaactacaagaatcactgaaagaaacacacaataaattttccatataagttgaattaatttatacctggataggtttatgtgcaaatcaataaggcaactagcataattaagaaaaaaattaaaaattcagtttctgtactgagactacatttaggtaaaatggttaaatgcaccagaaactttcatccaatcctaatgaaagataaattgtatgattttctggataatgcaattaattagaagctaattacaggtatatgtgtatattgtacactctttctgtacatacacaagttttgtttacatgattgtattacagccttcatcatcatttagcacagtattgagaaactagtagccattcttttaatatttggtttgtaatcaagtcaagtcattttaaaggtctgacatagtcatggggtgattctaataaatcctggacttagagtgaagactctctcactgatattcttgtaattatttccttaatcctcctcagattcagcctttaattcattttatcaagaagcagcattgctatgttaatttcctttatagtctgttgctcataagaagcattaataagcacagaaataataataatatcaacaatatttgatgtttggcacctgtaccaaatacaatgcatgtgactattgctgatcttcagataggtaatagtatctagctcaccaagattaagtaacttgcccagagtcacagtcaggcagattgaacccagtctatctcacttgagcatcactgtagaatattttgatcatacatgcacaccatctttggctgtgtcttcacgcagaaatctgttggttattttttgctgaggagactttgaatttttggatttgtgcctatgaatattatctctgttaaatactttacaaatggttaatacaatttatgatataatgaaataaatgaactggaacttgaaaataatatttagagaagagagagaaatgggagagtaggttaatattttagattcatgaactttgtggtgactgacttttaaggttaaaagagttagtgaatttttgctattttatatcattggttcatattccatatttatatcatttgttcaagttcctcaaatgttttttagcaaaataataatgatgaagtgaggttaatgtctgctatttttttttcatcaagttgaaacaagacaaaactcaagaaatcagcaggtcagagcaaacggacagaagagtccttttttttttttttttttcctctgtgtatgactctgggtataaatagaacagtaataaattggttttggaaaaatgtggtacacattggaaaagatgaaggctagcgcctggtacactttggattaaaatacgtatcaaacttccatattatccccttctgcctctgcagttaataaaaacacatcgtgaaatcgagatgctgaaaaaaacaagcatttctttcctaacattgatgacactgatttaataaaatctgtcgctgaataccctaaagtttgttcaatgagaaggatgtgaattaattaatttaaatatatatagattagagtagctaacaaataatatcattgttgcttttaagttagggaaaaataaccagtggtttccatcttgtcttttagaatctagtacagattactagttttattaacttttaattaaacactaatacagtaactggtttttcaaaaaatattagaatgatacacatcttttctgtgtgatcttgatatttaaggcagaacacaatatcatttccttaatttatgatatgctggactaacattttaattttttctttaaaccttgtgtttatttgacctgctgatcctgcaattgtccagaatcattatcactttggagattatttttaaagttaccttaaaatatgcagattgtttctgctcttataaaatgccaagtataaagaccaaagtaaataacttattaaatattaatggaattgcatttctgtaattgttgtgaatgcattctgtatgtagtgaattgttgggtctaattaattatatatttacctctgctccttcacaatttggccactcttttgacctaatttatgacatgagtcagaacagctgaagtagtcatttaacgcaactagtattttctgaagaaaacaatgaataatctctatgctgagtatctatctaaagtctaggaaaacaaagtcaatttggccaatttcactgagatgctcatttgagtatgttcctaaatgactattctctaaagaataactgaaaactagtgcttaatttttaggagcaaagacttcatgggttgtcttttattataattatcacttgaattaatgttataatctaattatatttacacttactagtaaatatgaatttttaaaattaacaatctgctttttttttatgtctgtgatgatggaatagtgcaaatttgttgttgacaaactcatgtaagactcatttgttttttggctcaaaccacataaaagtcactttcgtgctggctgcagtggctcgtgcctataatcccagcactttgggagaccaaggcaggaggattgcttgaggctaggagttcaagaacagcctgggtaacatagtgagaccccatctcacgaaaaaaaaaaaaaaaaaatagccaggcttggtggcatgtgcctgtagtcccagctactcaggaggccaaggcaggagggttgtttgagcctgggaggtcgaggctgcagtgagctgtgatcatgccagtacactcgagactgggtgacagagggagacgttgtaaaaaaaaaaaaaaaaaaaaaaaaaagccacaaagtttacaatagtggatttggcccagaatctgttattgtgagcttgaatttagataaaatagaaatatatagtgaccactttctttccataattataggtctgaggaatagttagatgacattttaagaaaagtaaaaaaggtaaatttaatgttttagcatttgtataatgcatttctggatattgtctccattaaaaaattaatgaaaatcacagcactggccgggcgcggtcgctcacacctgtaatcccagcactttggaaggcccaggcaggcggaccatgaggtcagaagttcgagactagcctgaccaacatggtgaaaccccgtctctactaaaaatacgaaaattgccgagcgtggtggcacgcgtctgtaatcccagctactcaggaggctgaagcggaagaatcacttgaacccaggaggcggaggttgcagtgagctgagatcgcgccattgcactccagcctgcgtgactgagtgagactccgtctcaaaaaaaaaaaaaaaaaaaaaaaaaaaaaaaagaagaaaagaaaagaaaatcacagcactttattttgatgttcatgtcattgactaaatatatatagggttgttaagtaatagtcctaaatactccaaagtatctaatgcacttaagaaatgcattgaggattttcaaaatatatttgctcttgagatcctcaatctactgtatgcattatacagacgtaccctggagttactgcaggtttagttctagctgccacgataaagcaagtcacatgaattttgtgttttccagtgcatacaatagttacgtttacactatactgtggtctattaagtgtgcaatagtatgtctaaaaagtacataccttaatgaaaaaatactttattgctaaaaatactaatgattttttcgttttttgagacggagtcttattctgtcacccaggctggagtgcgatggcacgatctcggctcactgcaacttccgcctcccgggttcaagcaattctcctgcctcagcctcccaagtagctgggattacaggcacctgccatcatgcctgactaatttttgtatttttgtagagatggggtttcaccatgttggacaggctggtctcgaacttctaacttcaagtgatccatctgcctcggcctcccgaagtgctgggattacagtcatgagccacccgcgcctggccctaatgatcatttaagctttctgcaagtcatagtcttgttgatgaagggtcttgcttcaatgttgatgactgctgaccgatcagggtggtggtttctgaaggttaggttgactgtggcagtttcttaaaataagataacaatgaagtttaccacattggttgtgtcttcccttcatgaaagatatctctgtaacatgcaatgttgtttgatagcatttcaaccacagaacgtcaaatttggagtcaatccactcaaaccttgcctctggctcatcaacttagtttatgtaatattctaaatcctttgttgttatcttgacaatgttcatagcatctttaccaggagtagattttatctcaagagaccactcttttgctcattcataaggcgcaactcttttgttaaggttttcttatgagatcagagcaatccagtcacatcttcaggcttcacttttaatgctagttctttttctatttccaccacatgtacagaatattaattcttcactgaagtcttgaacccctcaaagtcatctgtgagagttggaattaagttaatacttcttttaaactcctgttagtgttagtattttgacctcctaccatgaatcataaatgttcttaatggcatctaggatagtgaaatttttccagaaagttttcagtttactttgcccatatccatcagaggatgcacaatctgtggtagctacagccttatgaaatgcatttcttaaataagacgtgaaagtcaaaattactccttggtccatgggctgcaaaatgcatgttgtattagcagacataaagccaacatcaatctccttgtacatctccattagagcttttgggtgaccaggtgctttgtcaatgagcagtaaccttttaaaagaaatctttttttctgagcagtgggtctcaacagtaggcataaaatattgagtaaacaatcctgtaaacagatatgctatcatccaggctttccatttacatcatccaggtggttccatttgcagagcaaagacagagtagatttagcatcattcttacgggccctaggatttttggaatggtaaatgagcgctgacttcaatatcaagtcaccactgcactagcctctaacaggagagtcagcctgtcctttgaagctgtgaagctaggcattgactttcctctctagctatgaaagtcctagataggatcttcttccaataaaaaggttgttttatctacattaacaatctattgtgtagtgtagctgtcttcatcaaagattttagctagatcttctagagaacttgtggcatcttctccactagcacctgctgcttcacctttaacttttatgttatgaagatggcttctttccttaaacctcatgaaccaacctctgctagcttccagcctttcttctgcagcttctttacctctctcaggcttcatagaattgaaaagagctagggcctttctctggattaggctttggcttaagggaatgttgtggatagtttggtcttctatgcagaccactgaaactttttccatatcaacaataaggcttttcaagtttcttatcatttgtatgttttctggagtagtacttttaatttcctctgagaacttttcatttgcgttcacaatttggctgcttggtgaaagaggcctagctgttggcctatttcagtttttaacatgcctgcctcactaaacttagtcattcctagttttttatttaaagtgagagatatgtaactctttatttcactttaacatttaaaagtcatggtagagttataaattggcttaattaaaatattattatatctcagggaatagggaaacctaagaagagagagagagaaataggggaaaggccagtcagtggagcagtcagaacatgcgacatttagccattaagttcgttgtctgatgtgggtgcagtttgtggcatcccaaaacaattacaacagtaacgtcaaagatcactgatcataaattgccataacagatataaaaataatggaaaagcttgaattactttgagaattggcaaaatgtgacacagaaacagtaagtgagcacatgctgttggaaaaatggcaccgatggacttggtcaatgagttaccacaaatcttcaatttgtgaaaagtgcaggatgtatgaagtgcagtaaagcaaagtgcaataaaatgaggcatactcagatattgattttgcaatgctgtatagtattcataaatctccttagaatacaacgcttccttttacttcatcactgctgtcttaaaccaacatgttgggtaatagaacatttggaaaacattcaaaactattttgtatctgtttctgtattttaagattgtgtcaggtttctttagataccacgcatgtattttaaagatttaagggcagtttaggatgatatgttttcctttcaatgtacttctctgtaaaaaccagcattgaaattttgctttagtactgtatgaaaatgtgaggtcaagttttattttgtacttgtttaaacaattgtgtcataaatccatgatgtctgtctctctaaaagttttcgttctaaatgtttgtatctttttttaaaaaggaaaaaaacaggcctggcatggtggctcacgcctgtaatcccagcactttgggaggccgaggtgggcggatcacgaggtcaggagatcgagaccatcttggctaacatgatgaaaccctgtctctactaaaaatacaaaaacaaaattagccaggcatggtggtgggtgcctgtagtcccatctacttgggaggctgaggcaggagaatggcgtgaacctgggaggtggagcttgtagtgagctgagatcacaccactgcactccagcctgggtgacagagtgagactctgtctcaaaagaaaaaaaaaacggggaagaaaacaacctttttagtttttgttttgttttgttttttgttttttgtcttctagcccagcaacatcgagggaatcttaaacatgacaagaataacaaaatggtattgggagaaatctttttgcagtggggaaggaatcttcactttgactatgaaagggaggtctatctatctatgatataattttattatatgagcttaagggctttaaaatgatgttattattttatgtatgatctcttggagctggtttcatttcatcatagctctcgtaactttccaaattgctgcttaggccagcgtagaaggatgtaaccttgagcaagtcattttaccgatgaagccgcatctctcttctgtaaaatagggcactcagtaaacactaatgtatatagctattatttccttagaagtcattgaattattcggtaaaagtaaaagagcaaaataataatcatggactgctcaaccttagatttcccatccatttcttcaaaatatgctaacccaataatgtgatataaatctgtaagtagtcagcattgtaaaccgtcaatatttttatggaggttggaatagatattatgtgcacattgaaatacaattacagcaagtacttgattactctgggcttgaatagccagtgtctagattgcatcagcctttgtaaaacctgaatattcttcttctggccatttcactgttcattaaactatataccagaacatgagcagtgtgaagagattcagataaaatggaattcaaactatttttgcctgttaggaaaaaaaaatactgttaattttttagggaattttagctatgggataatagtaagagttttctttttttggtgggtgggggaggaaatctggcagtgatcagattgttttacacatttaaattaggttatttatgctctaccacttactgaaggtagttgtgagtttcctgtaatgtgctgaatcttaatttacactttaccatctgtctgtgcttaagattttaatagattttgccctatagtatcctcttgtagatgaaatccatctgtgggaaagcatccacttttgtaaatctacctagcctgcactattgggtctctaaaccagagatacaagtgttagtaaaattcaataatttttattttttaatgctaccttgttttattttattttcatagtgtagagctttgaataaacattaattagttgacctggtagcaacaatattgtggtaacgatgcagctgacagtattgtaacattattagtcaagtcataaggctagtgtcttattaacctgaaagtttgatttctacataaatcagtttggcttttctcttgcaagagtaaaagatgataacaaatcaaaataaaacctaccttattgtttgtttttagcacaaaattgctgcagtatttttttgttaacagttttaactacttatttttaaaaaagaagttcaggatctttttgtgacatcaaatctgtacagttatgctttataaattatggattgaatgtgagaaagttaatagtactgaattaaattcacatacaacaccagatggtatttaacaaatttaagaaatgcaactttttggccgggcatggtggctcacgcctgtaatcccagcactttgggaggccgaggcgggcggatcatgaggtcaggagattgagaccatcctggttaacacggtgaaaccccgtctctactaaaaaaatacaaaacaattagccaggcgtggtggcaggtacctgtagtcccagctacttgggaggctgaggcaggagaatggcgtgaacccgggaggcagaggttgcggtaagccgagatcgcgccactgcactccagcctgggcaacagcgtgagactccgtctcaaaaagaaaaataaaaagaaaaaagaaaaaaagaaatgcacgcaactttttgtaatttatggtcacatatattttaaatgtgtatggatgtttttatatatacacatatataagtatgtatatctctgtatacatgtagattcccactgtgtacagacatatatacaaatacctatatttatatgcaatgacacaaattgtatgtttgtgcatcttaatgctacatataacaaataaaatgattatgtagttatgtaatatgtaatgattatgtagttatgtattatcaatattgtcatagagataatgtctgtggagtcagtgtctggacagtgtctgtggagtcagttaaactaaatgttaattgggtctgccctttactgcttataggatttttcatctctttgagtcccagttgcctcacctataagctagtgcatatcaaaaaggatatctatggaaagtagatgagacaacaggagatgtttcaggcacagatcctgggacttttaaaggctcaaagttggtcactttcccttaggagtaaagcagtacaaaatttgtttgattctcaaaaggccacactatgttacaaatcagaaaaagaatctatatgcatggcttccaaaaccatgtggttattctccaaataatccagattttagaagaattaaataactgtaactatttctcttttattttccactggtattgtctttgagtaaaacaagaagatcaacaaaaatatgaaattacagattttaatagcctagccagtggctaggaaaatggtttaagcatggagcacactttatcatactttccaatgagccaataaatagaagaaatttttaaaaattaatttgatacatatttggaaagaaaatagaattctcactttacctgtccaactgggaaaaattgctccaattatatatataccctaaattttatttttattatagataccataaactggcattgatgcgtcccctaaaatactcttgttggctcttgcaggggatgtgtgaagagatatgctcctggaagcatgccccttgaggagagggtggcctctgtgctacagcctgaggggctttgacatgctacttctcagacacccttcacacagagccactaccccccacaaaaagaagacctacaaaacattcacctgaattcttttttttttaaatatgtttgctttgccaaataaaagtccccaggccacctccttccacttagtttttaagttcctcacaagttgcaattttgtagtcatcataatcttcagggtaaatgagtgccaaataatcagacatttacgttacagcaaaacgtaaaataccggcagattgtaaagtttgaaagatctaacaaagaaaaaagtgacattgctaataaaaatgctgtattgatgaatatcaatattgaaggttctggagtcacatcacaggttcagattcctgctctactacttatttgtggtgtatctttgaacatgttacttaacctctctgtgccttagttccctgtctcaaatggggaaaataaaaccactgacctcatagtggttgtaatgtagtgaggattaaatgagaaatacatgtaaaacacttagcacagctaagttaaaataagggttaatttttgccttaattccactattattatgatgtttattaaatgtgtttccattgcatagaactcatgaatgtgcttgaaggctggaattctttcacatttttgatgctacaatacagtcagtctttttacaaaaatgatagtgattgtgcaacagtctttaaatggaagaaagaaaataaataaaacacaaggcatctccttttcccattttttaactcaaacagtgaagctttatatggtgcttttctcgataaagcaccagaaataaattgaatgctgtttattagctggacacaaagtgtcctgattgcttcagttcatctaggcatgtaaattattcagcattccacactaaattggacttcaggatccaagcatcagtaggaagatatttcctgagtagcttaaccaaatgtacatgattgtaataagaacttctaaggcagtcctacaaggaaacaaatcactctgatttggtaaggaaaatggggagttccacaaacttcatatttttatctaggcacaattagcttacattcagagggacaattaagatgacagcctgcctagaagggctttgcatttgtttatttgtcctgttcctgatacccaccagatattctatcttctttctaaatattattttctttgctaaacaaatagcagagcttatgctcttagctggatccacacataaccttgtgaatcattttcagatgtcatagaaatgacataaacacagaatgtcagaaaaatattagccagaaatgcaatcaattgttcaatgataccataagagactaagtgcctggtacagtttggctgtgtccctacccaaaatctcatcttgaattgtaatagccataatccccacaacccccatgtgttatgggagagaccaggtggaggtaattgaatcacggggtggtttctcccgtgctcttcttgtaatactgaatgagttttcatgagatctgatggctttataagtgtttggtagttcctcctgtgttcattctccctcctgctgtcttgttgaagaggtgctttgcttcccctttgccttccaccatgcttgcaagtttcctgaggcctccccagccatgcagaactgtgagtcaattaaacctctttcctttctaaattacccagtctcagacagttctttatagcagtgtaagaatgaactagtaaagtgccctaacacattttggtctttctgtgtttctagaatgttgacttttttcaatcataaggctctttgccctatagtcacaagatagctgctacatgttcagccgtcacatctatattccaggcaagaaaaaataattggtaaaggctttctcctgaggatttttgttttgatttaggaagaaaggctctctccaggagatttttccctaatattttcttaactagagctggctatcactaaacctatcactgggcaagggaaatggctgtgaagtagacagtggacagtgtctaccatgcctctctttcacagatgagaaaaccaaggtctcttcaccagaacagacttgtgcaaggcttcagagtaaactgaagagaaaaagatgatcatttctggctctggtggctcccactctaccaaactgtactccctccattaatcaattaagtgtttattgaaatcctctctagaactgtgttattattcccaaaagtcagtcttagttacctataaggaataattagaaatccaaagtatattaattaataaatcagcataccagatatctggaaaaatactttgtaaaagatatttgtttattctttcaacctttacagaacctgatatagatttaaatgtcagaaaacttcttgaagcatattgttttcttctctgcagctactgtgtagtctgttgcctgctattttcatggcaacaatcacaagttggacactctttttagctataacaggactagactgaataggccagctgagagctattttacaagaaaatttagcaatcactttgcggtaatggatattggtttgtggcacatccgttctggtttctgccttgttaaacactttaaaaccagctctagcatacttagcttctctttctcaccctctgggaactataagtttactcgtctttacagttggtggtgaacaatttttgattttatgctgcttcaaatgatggaaaaggtactgatttattttaaggcaaagtgacaatatagtttgtagattatttcagaatttttaaaggcatttttaatagtttagagaaaggaagcaaacattttgttaattccttattgtcaatcccgggggaagctatagtggtgaattagtcaaccttgcattttacattagaaacatttttaatgtgattgctcttggtataagacacttaataaaatgtcatatttaaaaacaacatcctggcctctcctctgggaccatcaaaccacactcaaaacattgaagcggttcacaacatatatcttatggaaaaatgaatatgcagtgaatctatatacttatgattatagaaataaagtatatgtagctttataaagtagtataatgtttactctaaattttagtagtaaagagtcatgagttttgtatttaaaatatattattaggtctagtttgaaagctaattaaaagactcaaagaaataggactttattgcatattctttcacaaaattgaactctaattcctacacttgatatttactctaaacctgaaataatttttctgaaatattgataatgaatatgaaacaacctcctggatagtatttcttaatttctaagccagggtaagccagatatagctgaatgtgtaaaaaatgttgcaagagatcatttttagatgattaataaataatcaagattagttcttgtagttaacaaagggctgaaacagttgcaatattcagaagtcccaataatataatggttttgtcatggattaaatatttctggaaacacttcctacttgtcacagttctcataatgtactttcacttgatttaatataattaagtaattaaaacttctcaaagtttggtcagatctcagtttctccaaaatagaaatactaaatcgtgtgtataacttgcatcgggaattttaatataggtaggttctcccagtcacattgaggaggtcaccctgacaccttctcatatcatcccaatttcatttttgttcaaagcaagatctaataagaggaagaaaaatgatgccaatgctgtcagatctcaaacaccatctgtaaagtattccatattaccatgccattaattgtgttggcataggaagaaaatattggattgggtacaaagttatagggctaggtagaaaacatacaacttatccttttttattaatgctatatttaagcctacaaaactgaagggtttagttattgttagacagaaatagattgcatatggtatctgttagaaagcatcatcccagtaagaaaaagtgtggtcttgatggtgcacttcttcctcactttttattttcatcagttactttttactaccttcatctatcaatttccatttaattccttttaagggtagcatacataaaacattatttcatagtgcattattcaccctagaaagctcattgcattcacttgataagatacatttcataatttttaaaaagtgatttcattttgtatgtacttgtccttgcatagagcccaaagagctcagttctgttttagaggacattgtgataacttcctttataggcagaattaacgtaggcaagctgcataatgctatttattttcaggatttggtttttcagtttaagtaagaattttcattttaaagattagcaatctggtagaaaaaatttctatgatttgagcaagtttgcatgtaccgaaatgttctctctgtggaagtcataaatggtttcctttctggggaaaccagagtatagtatggccaattaagaaagaaaagggactaactattgagactgtgtgtgatatgctgttactttgtacacatcaaattgtttattccacataatgatcttgtgaagtagggacttactaaagtccaggttatttaccttcccttcaactttacagctagcaaataacagaactccattttaaactgaagactcatcccaaagccatgccccactcaatataccatacttaccatactgctagtaagattaaatggctcaaagtgcataaatatactttttgatgtaagaaattatttctgttttggaatcatggggcatgaagtttctaccaaagcaaaaaggttgcataagtgtttattgacagcaaatattctaatttctttctctactgtaaaatgtggataagaacatctataaacaaaaatgtctataataaaataagaattaattatagaaagacttagccttttaaactttttttttgttgttatttactgtaaagttgtcaatccctaacctgttatgaacaaaaatgtctcacagggcatttggaacttttacatgtaacgacttcctgcattcatccatctgcttctatttttaaacattggggtttacagacatttagcacagtgccaggaatataatatatttaaataatattgaatttatgcttttaataacatcagggcttagaatgaaataagcaattcaatctgtcaccctttttgcatttgtgtgttactaccatcatctcccatatagtctcttcttttaaaagtcctattatgtgtgtgcctaagacttattttgagaaatacttactggccgggtggagtggctcatgcctgtaatcccagcactttgggaggccgaggcgggtggatcacgaggtcaggagtttgagaccagtctggccaacatagtgaaaccccatctctactaaaaatacaaaaattagccgggcgttgtggcacgcacctgtagtcccagctacttgggaggctgaggcaggagtatcgcttgatcccgggaggcaggggttgtgctgagccaagatcgcgccactgcactccagcttgggcaacagagcatgactctgtctcaaaaagaaaagaaaaaagaaaaatacttagtttgaaaatcaattaaaattgaaattaatttagctgggaaaaatattaagactataacaaacactgtttgacagcactgcactgtcacaaaacagagttaaaacattaaaaagaatgttttgttgttgtttttttttttgagacggagtctcactctgtcgcccaggctggagtgcagtggcacgatctcggctcactgcaagctctgcctcccgggttcatgccattctcctgcctcagcctccggagtagctcggactacaggcacccaccaccacgcccggctaattttttgtatatttagtagagatggggtttcaccctgttggccaggatggtctcgatctcttgacctcgtggtccaccagcctcggcctcccaaagtgctgggattacaggtgtgagccaccgcgcccagcctaaaaaggatgtatttttaagaggcagtatggtacagcgagaagagccctgtaccgtacatcattaaaagagatcctggtgttgcctggttcataaaccagatgcttgtgtttatgaatgtatgtatggaaatttaaaaattcctgggctcatcacctttacaagaacatataagataacatacaggaaagtgcttggtaaacaatacattgatttcctgatgtaaatgactgctctgattattgttgctgttattaatagcaccaattaatagtagtgctagacttaataaatgatagtagttattggcataacttctcagttgaagtccaaaaagtgatttcaagtaatttaaactatttttatgcctctatttatcttatttttgggctatcccttctacacttatttaatttgtcctcatccctaagtggcgtatttgagaatgttatcattgcctaaataaatgtattacattgaaaagaagaagcatctcttaatttcttgatagttagtggtatgctggtaaagtggctgtcaaggagagtggggaaagatgtaaaatgccctaatttgtagagttagcggatttctgtatgtaaatactactcctgtggccagtttcaagctgtcctcgtgatgtcactgaccacagagttgagaaaagaagctcacaactgactcgagagtgggtgggagctgggtccagcatatacaccgtggacaagggatccaatgggtgtgttcaagatacctgtttcacagtgtaaactactgagaatgaaggcatgacagaaatatacagttctatctcaggagatgaccttttagctctttgactctcatcttaatacttgcttctgctttttaataaagcattgaaattcagtcttttgggtattcaaatctaaactctccccaccagatcctggcttggctcagcctgtaacccttggcagctaggtggtctccagaagaaatcccctgtttattctgcctgctccaaatttagcccactactctggccacagcgtcctatattctaggactggtcttctccactctcttctacccgagggtgtaggattcagacagatgtaagcatggtaccattgtgagttaagatggatgctgccacagtaggctgctgtgaagaatgcagactggagaatgaaagtctaataggttggtttggggtcgggtgcagtggcttatgcctgtaatcctagtactttgggaggcagaggctgatggattgtttgagcataggagtttaagaccagcctggacaacgtggtgaagcgttgtctctacaaaaatacaaagctactcaggtggctgaggtgggaggactgatagagcctgggatgttgaggctgcagtgagctgtgcctgaattattccactgcacaccagcctaggcaacagagactgtctcaaaaaaaaattaaaattaaaaaataaaataaaagctcgttttgggactaaaattttagattcatttcggtagcaggtaaactgttaccacagaatttaaatacacagtaactatctgataaatattatatatatataatttatatatgcattaaatataatatatacacattttatgtatctatcatatataaatatatatattatttttatatatatatataatttactttctgccttgtttcagaagggatttaaagtgtcagaattttaggggaggcatcgaatgggcaaatataatcataaatcctggttcttggggcttccaacttcatgtctggaaaataacagatgattcatacagaagatagcaaaagggtgcccagtgcccgtcataatcctatccttcattttataatcctaggtctgatttttggtttatttgtttgttttgtatgtttgcttctatttactgcctagaattcaactatggaggtttatttggtagaatttatctgctaaacaaggatttattacacttaaaaaatgcacatattctgagaaagctaagatgccagcgaatattcactcagttcagttatttttaaaaaattttccacattcccggtggaatctgctataggggaagctgttttaatggaggccgagagttggacaattttgtgttatggagaattctgggaagaaggaaagacccggatgggactgtttattaaggcttatgactggactggagataaggtaaattagcattgagaacatacagaaccacaggcaaagttctagttttttagtaataaaggggcttatctatacattttcaatatgaaggagtcaaaattgaaattcagctttatttctttacttcacaactcaagtttatttcttttatttatccattcagcatttgttaaattgttggattgtgccaggcatagaggtaccaaaaagcatttttagctcagatttgtagtatcattcaaacatatcaaaagtctagccaggaaaaccaagcgatatttaatatttgtctttataaactggagaatgccaatattctactcccatccttcaaggatgaattacaaaatctagtcacattctcagcatctgcagtttgtaacaggcctggcatccagaaagacagcctagtggttgtgttctaactatccttttaatggtattagttctggaaaagctggattttctgcttgaaaagaaattgaaaagagaaaatcattttcaggcattctttcttttttttttttcttttcttttttttttttttttagaggcagcctcttgctctgttgcccaggctggagtgcagtgcaccatcatagtttactgcagcctccaactcccgggctcaagtgatcctcctacctcagcctcccaagtagctgggactataggcacataccaccatgcccagctaattttttaaatatttcttgtagagacagggtcttgccacgttgtccaagctggtattgaactcctgaactcaagcgatcgtcctgccttggcctcccaaagtgcagggattgtaggcgcgagccactgcatcccgccccaggccttctttcttttgaagatttgtggttctaccatttatttgctccgttgccttagacaagttatttcattttctgtacctcagtttcattatctctgaagtggagacaatactaggatctgcatcctaaatctgtaagtattacgtgaaccttgtaaagttcttagcagtgtctggcacatagtaagtgctacaactctgccctctactgcttagagagaaatgtgaggcctaaacatgggtgccagatttcaacctgaaacacctccacccttgcatacacgcacacatactggcaacataatctggcctattaaaaaaaaaaaaaaaaaaaggattacacagtgaaagaaacaaccaaaatggaaggaaatatcttaactagaggtaatctgacataaaaccattgtagctgacaatggcatattaaacccaaaaatgttctaacctacgttgtaaaaaaatttaaactacatatataaaattatgtctttactgctgagattcttttttaattattaagcaatgcaaaacaaaacaaaataagaatattcaagtataatgcttatcattctcctaatggaaatacagagttaagtgctatatattaaatatgtattattataattatacattatttgggtgaattaagttgacatctaccagataaggaaatatattttgaatatctatgttaacagaagatactgtcctttcttttgaactgtttaaaataatttaacatagttaagtaatactcagtaggctctggaaaatctgtgatctcacattcactgttaattcaaaatacactgaataaaatactattcaggttcatctgaatcttggacttacggtttctaattctgagaccagacaacagacttgtggcaccatcttgttctctcacataatgggagcattttggctgtactgagaagactaaactttagtccagtatgtgagtctcatgacaaattgttgtttccgttacctgtctggtaagaagagaagactcctgtccaattcttcaagaatggtatggaggtagacagcaggaaaaaaatgtggttttttttccctgtttaagctgctacattccaacttggttatggagtgtaagcatgcacattcacaccagagtgaatcgtgtggaggctcttgtccagtagagccactatccaactccagcatcaggcatcactggaagactcatcaaggcattcttccaagtgggtttacaagtaccagaatagtctgtaaaatgagtccttggcatcctgaaatggccctggatcccaggggctctgaagagtgagaatgagccaggttgtctttagcttagattaggtcctgttttactaggcagctaaaggtaacaggttgaagtgatgcagggaggaaagatgagagagcctttaatggctcaagtccatgagcagtgtgggagtggaaaaagcacaggatgtgcactgagggagttagaattcggcttatcctcctctgtactctcatggtgccttatgaaaaactcatcgcagagctgagcacattgaactctaaacagttttatgtgcctttctccaccactgtatcatgagctatttggaacacacacaatattttcttctccaaacttttaattttgaataattttaaagctacagaacaattgaaagaatagtacaatgaatatctgtgtgtacttcactagattcactaattgttaacatgatgacaatgttatctttctcatctcttcaggaagatatatatgtatataccatgtgcatacacacattcatatatctacataaacacacacacatattcttattttatttctttctttatttttttgaggtaggtcttgctctgtcacccaggctggagtgcagtggcgtgatcttggctcactgcaacatctgcctcctgggttcaagcaattctcctgcctcagcctcccaagtagttgggattacaggcacgcaccaccaagcccagctaatttttgtagttttagtagagacagggtttcgccatgtcggccaggctggtcttgaactcttgacctcaggtgatctgcctgcctcagcctcccagcgtgctgggattacaggtgtgagccaccacgcccggccacacattcatttttcttctgaactgtttgcaagacacttcacctctaaacacttcgtcttgtatctttaaagacccagacattctcattactacaatactgttatcagagccaagaaatttaacactcattcaataatattatctagtatgtaacctgtattcaaattccttcatttgtccccaaaatgttctttttctaataataataataataatccaagaataagcaaggttaccatgtttctttagtctcctttaatctagtaaccagcacctgcttttttaaaattttgtgacgttaatgtttctggaaataccaggccagttgtcttgaagactgtctcccatcgtggaagttcttatttgcttactgatcattaggttcagagtatatattttttggggaaataaccaaatagatgatattggacactttttatcaatttacttgtaaaagtacctctctgcctctgtaatgaagaaggaatctgtaggggatacttcaaggccatgggaatatcctgtttccccacattctttcacccagcagtttcagcatacatcagtgattcttacctgagtctgttactatattggaggatgaaatggtgattttttgtttttaaagtttatcattctttctgcccttactaactggcattcttctctaaagaagacttttcccccaactcctctccttttctaaagcttctccttctctctccccgccgacgcctccttccctccctccctctgttagagtatctctatagcctcatggattttccttcagtaaatgtcttataatctaataccatcattattatatttggtgcccaaattatttcaaatttggccattccactgggcgtggtggctcacacctgtaatcccagcactttgggaggccgaggcaggcagatcactttaggtcaggagttcaagaccagcctggccaacatggtgaaactccatctctgccaaaaatacaaaaaaaaaaaaaaaaaaaaaaaaagccgggtgtggtgaagcatgcctgtaatcccagctactcaggaggctgaggcagaagaatcgcttaaacgcgggaggcagaggttgtagtgagccaagatcatgccactgcactccagcctggatgatagagaaagactctgtctcaaaaaaataaagagaaaaaccaaatttggccactgggagccccaccaagacagtagtggtgtcctttcatcaagtctcattagtcagtccttcaacacttctctgctttctggtgcaacaagatgtccagagactctttgtattttccctgtgccagtcctggagtcagccacatttttttttcaaggacttcttgttccttttagtggtaaatggcatttataaaccaagactggggtgtcattgcttctaggacaaaatgaagtaattgctttgagagtacttggtgaaatataaaatgctatattatcatgactatgattagtgctatgaaacaagtattcagcttacttggaacaatgccaaataggagcaccaatataaatctgtgtgcagggaataagtaggaggtaggatatatgtgagggtgaaggaaataaataagctagcttggttagatacaacatgagtccttgtcttctgactctgagactaaacagaacagatgaaaggctatggattgcattctcacctgttccctgtgctgctttgttatttaatacttcagataggaaagcatattttattttgtgatacattgaaatcttttcaaaaaaatgaaacatttatgtgaagaatgataaaacatacatttgtgatttcttgtgtttttacttttcttacatttatttagtaggtctgaaagaacagtgtaatttagggaatataagattttttaaaattgcaaacatataacttcttttattttcccagtggatgcagtacctatgtcacatttaaggaactggtgtggtgacaactttgagattcttttttttttttttttgagatagggtgtcattctgttgcccagggtggagtgcagtggtgtgctcatggccctctgcaggcttgacctcctgagctcaagcaatcccccacccctcaggctctcaaagtgcggggattacaaacatgaggcactgcaccttgccaatgtttatattttttgaagagacagggtcttgctgtgttgttcaggctatctttagatttcttgtgggcaaatggattgttgtgggttttactttctatgattctatttcaagtaagaagcacacctatttgactatgatttcatttttaatacatactataaatatgatatggtttaatttcaagactttcttgcttttgccgtatcactttatactctcaaattaaaactcttaaaaataacttacccctacatgaccacagattatgataaattggacagaggacggagatgagtaaatagatgatgcttagcatctcattaatagcaaggaaggaaagcaaaacagcccagatgaccagaaaacaataattcttttctttatatcttcatctggactgttacttctgactatggtggcaaaagcaggcatgaggttggaggaaggagaacacacacagagactcaatgattttacacgtcctcttttcattagaagctaggctaaaaatagggaagaacaaagacatgtattgtatgatttatgtcggaatgtcttttattcttatatttttggttttgtgtcaaattcaggtgaaagaatgtcaaatgcctgtgtgtgtgttggcatctgaacttggcaaagaaggtgattgggtttggtagggctttattccagctttttcaagaattcctcacttttcaatactgaacagaacaggccattctgataaagaatccattacatacgtagaaaaattcaggctcatgaagaagctggggccagatttgtctgattcatgaaggttcttcagtttctagcagtttgtccttggagaagttatttaacctctctgagtctcgacctgctcacctataaaatggaggtaataagaggacattcctcataaggtctgattattatgtgtaaagtgcttaatatagtgtaggcaaattataagcacacatcaaatattagctcttatttttattacttatagacacataaatggacatgttaagaaaatatgattacttcttatcaatgtttgaaaattttaaaacaatccaatcaacaaatgaattactcagtcttcaaactatgttgtctaattttattttgttattggtttctttaactttcttcttttgaggtgcaatatttttaaagcttttacagctctctgtattatccagaccaccaacttaatgtaaggcacattgatgaagcactcagcatggccagggactcttgtagttgtgaaggatccaaaaatataatgatatagttctccgcaagtagctaactctggtagtactgaccattatataaacaaggaaatgtcattttgtttgataattactattacaagatatagtgaagttataaatttgggaaaattaaggaattccttatacttaagggtcatgaaagatatattgatgttccccaaattaacagtgctgaaactcattcttcaaaatgaaaataaatataaaataattttgctcagtgactagaatatttttaagaaagtgtgctttaactctaaagcaaacatgaacacatatgtgattctggatattatactttgggatttatcataatgcccaaggcactacaatattactaatttatttatttcctctgggcatcttgtaatttaagagggtaagatatcattttcccctttcactggagcatatgagtcacaaaggtagctacacactgggggtgtctccagcttgaaaaaaaaagctaatgcaggttaggcacgctggcttacgtctgtaattccagatatttgggaggccgaggagagtggatcacttaaagtcaggagtttgaaaccagcctgtccaacatggtgaaaccccctctctactaaaaatacaaaaattagccaggtgtggtgatgtgcacctgtagtcccagctactcgggaggctgaggcaggagagtcacttgaacccagaaggcggaggttgcagtgagccaagattgcgccaccacaccccagcctggatgacagggtgagactctgtcaaaaaaaaaacaaaaagcgaatgcaaacagcatcccagtgaagcaccagaaaaactgaaaccaatgcctcaaaagcccagcggtgattgcacaccagctcaaataccaaaacagaaatttttctctttcttgactcctcaactagccttagaatataaagcagtttttaaaaattgggggtcatgtttcatttttgaaaaattgaatcattaatgttagttatccacacatctcaggatattaaaagactaagaaatacattaccagaactgtttttggatattccattgcttcctgggtacctgattattcacattatgcacattacttatgtgaatgtgctgttgaaattttcagctagaggactgagatgccagaccttaactcctgccaggtctttagccttgtctctgctgtagaatcagttttgattatatacagaatataagagagtacagagtagtagaatggagttttaaaagcatacctgtagtataaaagcatatgacctgaattcatatccagtggtttagtcttcctgtgtcctagtctgatcatctgtaacatgagtataatgaaagtaaccacctcacagagttgctatgaggattaaacaagttaatggctggtgcaaaagtgattgtggtttttgtcattaaaagtaacggcaaaaaatgcaattacttttgcaccaacctatacaaattgatgctcaaaaaatgccctgtccttagtaagcaccttataaaagattttcattgttatctatagagatccacgagaacaaccctccttcagaggccatatgaatctagttcaagattaaggacacctgcatcgccaccagcttcccaacccacccccgtatacttctctagctcatagtgaaatcccttggcctctctcagactaaagcaacagtgtggctggaatttccaagctctggaatccagtcccaagctctgaagaccaagatgatattaacatagccccttgtgggcgctggctgtgctgttcccaaattcctcatagaggttttggtctcaaccaagatagaacactgtggaagctgaagtaatgtactttcatctgaaacagacaggtgtcttattcactttatactttgctttgcgttgaaaaaataagctttttttttctatggttaccagttcacaaacatcaagtgcaaaacttgcacgtactaggtgataaaaatatggcaagaatgctgaaggtaactttctaactttaagcaatgtttgtagatcttatttaaagcatatgttataaataccatcttggaatcctctttgtactttcattcatctctcaacagtcaatgtgaaatgaaggtcagttagtcttaaaatatccttgatcagagcatttttttctggatttttacctgttattaccgatcgcagctaatgaaaaagggataatacgaaaaggaaaatgaatagaaaaatgaagggaaattcagttgcttcaaacaatacattttaatttgtaatatctgtaagtgtagaagacattgatataattcagtatgctttgttctcagtgcaaattcatattcacatatagattgacccctgtacctcatttttggaactccctgttggttttgtatgtacaagaggcaaatacctttacatctggtgaggaaataatttatctcaagttattttgaatcatttatgctagtgttttttcaaactggatttaatgaaccagtagcgccagcatcacctgggatgctaatgaatgcatgttggactgatggcttacctctagacttctgagtagaattacacaaaggtgaggcccagaatctgtgttttagcacagctctgtggagtaaaaaaaaaaaaaaaaaaaaaaaaaaaccaaaagccaggggtagccacaaccttcatgtctactttcatagccccttccccatagatggtgctggggggcagtgcaggttcttatttcataacctgttatggtggtggttgttttgaaccacagatgcaaagaattaaccttctcataatcctcacttctttggctcattatcatcagatcatgcaaatcttttttcatgctttacgttattttaactttttttcctttcatttctgagctccacttccattctcctgcccccacatgccctcattgcaatgtgttgtagagatgcccatactgttctgtttctgccttttttcactcaacagtttagagtttctaacagctgcacaggacagcaagattccttctgccacctgtgatgtgtctccgccccttgctgtgaacacctcagttgtcttgactcccaccatcataaataccgagctcaagcactaaactcagattcaccgcttggctgcttcactttcattaggcttcaagattactcataacatttaatttgctattaaatctagactttaacaactctttttcattgattgtgttttaagctgcctggataacatgtattaggaggaattgcaaactcaatggaaaatttctttttgtttttatttttttgagacaggaacttgctctatctcccaggctggagtgcagtgacatgattatggcttactgtagcctcaaccttttgggtttaagcaatcctttcacctcagcctctctagtagctgggactacaggtacacactaccatgccagctaattttttttttaatttttgtagaaacagggtctctctatgttgtccaggctggttttgaactcctgggctcaagcgatcctcccacttcggtctcccaaagtgctgggataataggcattagccactattcccagaccgaaaatatctatacattacagattgaattatatctgtatttccttaactatttccatccatgatttatagcttctttaaaatgtcagtcataggtatatccttatccaaagtttttttctttttctcacatttgtcatacaattttgtgatctttctctctgaggccgttagctctttgttaactaacctaagttcctaagaaagtccaacaagaaatcacaaattcatcctctctagtacaaaacatctgtcctgtgtgggcatcatttcccagtgaaatattaactcttaatacaaaggtcacaatgtaggattgttttctcttgttatttgctcatcgggtctcttaatcaaaaatgctacctttggatttcttgtccgactgcacagatgtttaagaaggaaatttttctaagcaaagatttttttaatataagtagccaagcattcaatctagggaagaatgcaaccagccagtcaataatgatgaaatacttttttgtctgtttttcattctccctcactcagcgactgctgactatgcacctccaggccagaggcctattgagagtgacattcactctttccaagataatcctcatgataggatgcacttaatttatcctgttgatgagactgaactgcattgatttgcatatcatcaatacacgtaagtcctgagtggaggaccaaccatcctaattaatatatcctctgtcacggacttgctgtatctagcaaattctggaataatgctgattgcaggtggctggtgaatattgacgctgttcaggatttataaggctgtattggaaggcacgtgaaactaaaatcttccttggaacaatgtccctgtttaaaactactctcattcagacccagctgggcattcagcaatgccagctattgagtaagatctttcaagtgcctcagcctgcttcacctgtcagactggctcagtggtttaaaaatgaaactctatttgtttccaaagctcttcatcctccaactcttctctatccatgtcgcatattcttgcttcttcttctgatttgagtgtcttaactctcctaacacacatcatcagttttcatttaattcttttttcaagtgatgtacaaatagtgctgaatcagtcttggcgtttctgtgctattttatcatcttcacaacccccgtttgtttctttgtttttttgttgttgttgttgttcttcttcagcttttttctgttgtaagataagtttctttttcatcacacttggcttttaactcatgagtgtcagtttctcaaggtttccttttgtgcatttcttaacacaggcctcacatccctttctctcatccgccatcaatcaatcatacattttgttaaacagctccaaaataaaataagaaattataagaaaattagaagcatccccgtgccactagaaaaatctgtttttgaggcatcacctgcttttttctaatatgtcatctatatgcgtataagcattacagtagaaagtatgtataaactggacatttgattcacttttctttattttttttagcttcactggtttaaaaataaataaataccatgctgcagcactacatacaatgatctcagtgacaacatatcttcctccccatcagcgacttcttccatttttttaggtcaatgtccacaacacaaattaacattattcattgtacccagtgtaaaaggagcctaccagatattagagaaagttttgtaaaacacatcaagtttgcccctaactaacataaaaccaaggacctatatagatgaaagtttatttaaatgattccgtaactattttccttgactatgttccccattactttggggtaaaatggaggagaaagagttgaaaaggggaaggcaaaacaaagataatggaaaagtcaaaaaaagcaaaacacaagagtgtggtagctcaagaaaaaggtcagtggtcctgggggtgtggaaatttctcttccagacagatctgttggcccagattcttacaatagctatttttgcattccatttgaaataaaaaagtagatagaccatgcctagaaaaaaaattgagttccgttttacagaatattaaataaaacactgacttcttcaattatatgtttgctattagtagcaaaaggaaaaaaaaagccacaaaactatggaaaatgaaacgagtataaatataacataacatgaactctttctcgccaacttaatgataatgttgagaaggaatatacatatataggcattgcttatgtataatatttccttttgatttaaaagccagtatatcttttacctaaaatcctttgcagctgagaaatctgatgatagaatgagccatgaagttttagtagaaatagaaacagtacgcccactcttcatctaagttcctgtttcttttcacactagggatttgatattcatcatctttattctttggttccaatcaataggagaatttggaactttcatgcacatgtagatgtacttgaatacattctaaatattcaaagtgtgttgtagttctgttttattgaaatatctataaataaatacctgcatagataattaattctctcttctcatctctattgtaaccttggtacaaggactagaggaagaggagagactaagaaattacatatgtaattcctggtgaccatcaccctagggtacactgtcccctcaacagccaagagaataagtctggatttcataaatttttggaatatggatttcagttattcacaaaataaatatatgcattttcagaaatcattccacttatgatattgtatttattaaaccatcaaagtagacatattatttgaactgggaatattagatactgaaaataaaagctataggatcatgcagaatttaagcttcttcagaataatctggtcatgttaaggttaaagattactaaatttaaatggattggcactagctgacctcttaagttctgctggctctccaattcagtgaagttgctgaagactgaaggaacaagagaggtttaaaatattgagatatattaatcttcagtgcttagaaagcagtcaacaaaatagctccttttagtagttttcaaaaacaaatcaggtatttagatctactgtcatgaaatgtagcatttgattttgtagcatttgatttgatttcagtctttcatgaaattgtaatggccccacttgtggagaatttgattaaatgaaggttcatttcctgctttcaagaagatcagccaagaaattaatgactctagaagatggttctgcttgactggttggctgctaaataaaaattttatttagtaaaaaatcttccgcactaattctcttaattttccttcatggtttgcccatttctcttgcaaatattgtttgcctatagggtagttgtacctacagtgaatacggtttgtcttaacacttaggttatatgtaagataaaaataaatttactagttataactaaggattcacaagtagataagaaaaactgctagaataatttttgtagaaataaaaaaataagtaaatactttttaaaacttgaagtaaaggaagaggggttactcaaactccctataaatgtgccaaagatgaaaaatctaaaatttgtatattcaaatagctaaccaagacccaaaataaatgaaacacttacactacatgttttatctcatgatttctgaaacttttagccctaagacttttaggaaggtaatttatgcttcttatatgagctttaatgttttaatttcagtgtttcagtgttcatgcatgcatgaatgaatatttattgaatatttattgtgcaccagttatataccagacctagttctaggtatttgggatacattcatgaacaaaacaggcagagtcttgccttcatgaagcttacaagtgaatggggaaagacaataaaggataaacataacaagtaaattaattatgtggcacattagaagatgatagcaaaatggagtaagggggattgggagtaggaattacagattgcagtattgaataggatggtcaggtgaagcctgcttgagaaggcaatatctgagggaaaacttcatggaaagaatagaattgtctgaaatgaaaaagtgtccacaccaaaatttaactattaaaaatgtgttaacttttttaatggacatagattacataacatgatatggtgttttctcatgtaacgtttaagattcaccatgatgtttgatgatttctaacttgatagaataaaataagggtagtgattgtgttaagatacgtactttactattatcatctgtacttctaagataggagttaatttcaacaagatgtttcaaaacaatcataataagcccaaattgtcaaacagcaaagttctttaaaaacccatgagcctatattgcactcatatattctatatcctctgccaagattaaaccagatagatagtaattaaaattaagatgttttcctcacctccaggaatgcttgtttatacatatatattatttaaatatgaactgatggaatctgaaataattctgacagtaaaaatctatatttttaatcttatctgttttatgcacagcctacttacataacaagtagtctgtctaaactccctctcctggaaaaatagaaaattcttaattctgtgtttaatttatctcttccctttctgctatcttgtaagtgtaaatggaaaattcttagttctatgtttatctcttcctcttctgataccttctaagtgttaggctgaattacaaactaattagctgagaagtccagggattgaatttctgctctaccacttaccagctgtgttcccctgggcactttactaaacctaattaggcctatttcctcaactgtaaaatggaggcacatgactctcagaattgttgaataaaataatgtactcaaaaagactggcactttataggttcttaatcattttatcagaatcatgtcatatgcttttcaaattcgcaaatattagaataaataactgaatgtaaattactgaaaaatggaccaagcccgtatctaataacaggcattatagtataatgatggtttttgttttttgatttatatgttggcgattctgagaaaggaaagagctttatgacattatgtgcttgtgggaattttggaagccattatgaaaaaggcacaattttaaatgaacctaaaaggaaatgtaagatttgggttggaagagaagaaatcagtgattcctgaaataaacttacgattacgataggcctcaatgggtaatggatttttgtgaaaaggatgatacgggaagcatcttagctgtccattcttttgtcataatagcgtagttctgtaagggctgcttcacacaaatactttcacttgttgccatattcctaaaatacaaattttacttccatttctcatttcatgtgcttttactttacagttgccatttatttactaaaagccaatgtaaaacatactctccctactaaggagaatgtgcccttacaatttgtttatttaatatacacataatcatatagtctttatttacacagccatggttacatggtatgtgtgtaaaatatatgcttatacaagaacccttttgcataatattcactatagatcctaaaacttatgaatgaagaacttctaaaacaatggcaccataatatttattacaatttttattatgaaggtacattacattaatagagtgccctctaccccatgtcactgccactcaggtcaagaagacattgtacatcttccaagtcaatacagtctctcatactactttctacagaggtaaacagtattccgatttctttctctgaatattagttttatctgctctggaagttcatatattattccatatatttagtttagtatttactttcactagatattgccaaacagttttccaaagtggttgtattaatttaagctctcaccagcaatgtatgagagtcttagttgttcaactattatagttttcctttcaacctcttgagagcttttaattcccaacatagttcttaaagtgtaatgagattatgacttcaggaattgaagtagcaattatttttcataattatagttcatgtgacattgtttttaaaaagaagtttggtttattttactttagtaaaagtatgtgagaagactagaactttgagtatagttatttcatgagcttaggtggtaatgtcatatgaaatctaaatatggcttttaagcaagtgtttttattaaattgcagtcagactttgaatgctgacaataagaataacctgtctttctttctctctctccatttataccatcccattggctttaccttgataagtgaaataaaagcactgatggaataaagaaaaacgagaatttattacttttagaattgtgcaaaatttgtcagtgaaatatgaatatctcggaggttcaagatggtgcataatccaaaaataatttgaaatgtattatgtacatacatttggataagaatataagtgattttttaaaaaaatcatcatactaagattctaaatgaaatagtcaagctaaactctgttcatcataactcagaagtattaaagcctgattcaagagcaattggaaagtgatttctagttatcttgtcttactcttcaccctacttggttggaataaattcatccttctcattgcagtacaactctaattaatatcacagtgactatgtcaaagatgaccacatgcaacgcgtatctcaatatgctctttgctttttataaatatactttattttgtaatttgtttttcatccaagttcagtggagatactaaatattttgtttaaatatttcttactgggttttatgtataaggcatagttaaaatacatataaagtaaggcagatagttataggactttgggcttgtataatatcaatattattttcaaattttaagtaagttaatagcccagagctcagtggcatagaatacctagtaaacttaaatgaaatatcaaatagacaacaagctaacaaatctagtccattttttaatcataacaaaacttgtggcaggagtcaagtgattcaaggattctactttttcaggagaaattttgttcctcagtaataaatttgtccattgtttgctgtcagaattatttgcatgagtttctcaacatacagatgtttttataactagtaactcagcttcgttgatggtgtatagttaatactttttatagttttctatgaaaaacaaaagacagccatgagagtgatttacatatatttatcctttagatgcttagtgattgtctttcaactcctgaccagttgttctttatcacataaatcagggatccactagagcacatatctttcatttataataccatgttaatccatttgtccatgtaaaagaaatttttaaaaatggagatctgcagatctgcaattgaatttgttaaagaattcaagaaacacttctagaagattttcagattcccacatgaatcagagtctcatggcctcaaaaaaatgaatagcttttggagccatgcttctaacaatttgtaataatctggaaggtgccatggattgaattataaacttgtcatattttaattagtggccatggaattcaaagacttgctgcctagagactgggacctttttattacttttttatctttctttttttttcttttctttatttttctttttctgttttttttttttttttgaggagtcttactctattgcccaggctggagtgcagtggcacgatctcggctcaccacaacctccgcctcctgggttcaagcaattctcctgccttagcctcctgagtagctgggattacaggtgtgagccaccacacccagctaatttttgtatttttagtagagacagggtttccccatgttggccaggctggtttcgaactcctgacctcaggtgatccacccacctcagcctcccaaagtgctaggattacaggcatgagccgctgtgcccagccccttattactttattttttactgagttattgagatataattcatgtggcatgaaattcactcgtatacaattcagcaattcagtggtttttaatatattcatagagttatgcactcataaccattacttaatttcagaacattttcattaccccagaaagaaggccctacgcattagttgtcactctccattaccctctgccccaagcctctggcagccattaatatactttccatttttatggatttgactatcctaggtatttcatataaatggaattataaaatatatggccttttgtaaccaccttctttcactgagtataatggcttttaggttcatttgtgttgtgacatgtcagcacttcacttttttattgccaaacaatattctatgaatataccacattttttaaaagttttattattaatatttttgactgacaaatcataattgtatacatttatggggtaccatgtgatgtttatttggtttttgtacagtacaatgttattacctatgattctcatggtacattcgatctctagacttgctcattctacatgatgctatttggtatactctaacctacatctcctcattccctgccactgccaaactgtcccccagccctgtcactggtaaccacagttttgttcactgtctgtatcattgaatttttattattattgttatttatatctcacaaataagtgagatcatgcaatgtttttctttctgtgtctaatgtactacacttagcataatgtcctccgggctaatctacattgtggcaaatggcaagatcctgttcttttttagagctgcatagtatagatacacacacacacacacacacacacacacagacacagagattatggtttctttatccattcatccatctacagacacttagattgtttacatatcttagctattgtgaataatgctgcaataaacatgggagtcattttgtacaactcacgctacccaatcccgcatccatgtatagcttctctaggtattaggttgaaccatttgaaattggcattttgtaggtaaaaagtaatataattttatcattttgtatatctaagactaatgtgctgattatgacactttttgtcttttttgaccaaaatatatttttgtgtggaccaactttgttggaagagaaaatgtcatctatagtaaataaggcaaaacagtgttcagtgattttggatatcatgataatttgtaaaatacttacacatctgcctatttgatttagaataacaaactcaagaatactaggggaaagcataagtattatttctattataaatttttgaaagtacaaattttagtaagtgtagtcatatctctacaaaggtcattccaaaatattttggccatgaggcagcattaatttgtcaaattttattttaaaaatctaaaaattataatttagcacattttaataccaagagaaggcatgatttatcaaacaaactctttctgagcatttaaaagctgatagccccatgctaggtactttgcagaattcaaagagagtaggagacaagtctctatttaaaataaatttacatcctataatagaaattataaaacatattgattacaaaatatatggcaaggaaggccgggtgcgctggctcatgcatgtaatcccagcactttgggaggccaaggcgggcggatcacgaggtcagaagatcgagaccatcctggctaacacagtgaaaccccgtctctactaaaaattcagaaaactagccgggcgtgatggcgggtgcctgtagtcccagctactcgggaggctgaggcaggagaatggcgtgaacccgggaggtggagcttgcagtgagccgagatcgcgccactgcactccagcctgggcaacagtgagactccatctcaaaaaaaaaaaaaaaaaaaaaaaaaatacatatatatgtggcaaggagtcgcttacaaataaaaggcaatatttttaagaaagactgaatatatagaatagggaagacaatatggaatacaaaaacttctcttgtgtttagacattccaattcatccactagtgtgatttttcatattcagtcatttaaaaaacatgtttgagtgccagtacgctccaggcactgttttaggtgctttggataccagtgtcccaaacatgtaaaaatgactgccctcgtggaactagcggggtgaagttagaagtaaataagaaaagtttatgctatgataagtgctatggaaaaaagtaaaatgcagcagggaatgaaaagccatggaaagggcatggttgcaactttcattatggtagttaggaaagccctggttggaagatgatctatgagcaaaggctttaaggaggtaaggaagataagtctccattattcattcctggagagtttaggtagtcatacacaaatacgcagaccaatatatttagggaatgaaatcaaagttatttcagaagaggcacaggggtgaattaactaaatttgggagtatagctaaatcagattcttaaagatcaggcatctacaatgaagcagatatgacagaggggtggagtcatagtatctcatcaaagtgagaaaaggaagtgtgaagttaggtttctgctaatttatttatttatttattattttgagagacgaagtcttgctctgtcgcccaggctggagtgcagtggtgcgatctcggctcactgcaacctccacctcttgggttcaagagattctcctgcctcagcttcccaagtagctgggactacaggcatgcaccaccacacccagctaatttttgtatttttttttttagtagagatggggtttcactatggccaggctggtttcaaactcctgacctcaggtgatccacccacctcagcctcccaaagtgctgagattacaggcatgaaccaccatgcctggccttctgttaactaatttattaaatgaagtgtcttgaaaaggaaatcctgtttcccactttttttccattcccagaacctgtaaagagtctgaaaaatatgtatgtgtgccatcacaattgattgaatggatgaatggtggtaatccaaggtctaaaatactgtcagacagaagaagggtaaggcaagcatcagtttaggcttttgggcataaatatgaaaaatctaaaaattcacagaagtatctcaattgtcggttgtcttgtattcttagaatatgacatacctaagggcagtaattatgtttcacatatggtacttactccatgttggaaacaattgggaaaaaaagaaaagaaaaagagtgtaccaactcattctcatgtactgaactaggtatccctaaatattaaatgacctccagagagtattaaatgtttttggaagctgtgctatttttttagactgaccaggaccctgttatgtgctttcatgatagaatatgattcatgttcccagacataagtcttaggcatcattttttatgttcagaagtgaacagaagacaatacattaaaataaagcattcactttgaaaaatcacctcattatccaaaatcactgaagaaaaatagacatttaacagggagattatatttaaaggggcatttttttttttgcgggtcgggggaagaattctaaccagtatgtaggattcactaaaacctgaaatctcttgtgattattacctgtggtagtcatacattttcaaaatgtgatttattcattttatagctacatactggggagagaggatgatgatggtggcagcaactgtcttttagacatcaaaaaaagcagtatgaccctatctatagatgagttaatccaaaagcattgaatcatataaactgaatattgaaagaacagtttggaaagaaaataaaaacagtaaaatatgaaggtcaaaattctagccacatttactgagtagtttagaaagattttaagaaattttgcgccctccagtggttgttttggaatgaattattatcattattattgtaatttttaattttacctgggctttccattttccagcttcattgtttttggtaacccaggaaagtttaacttgtctatacctagaaggtgccttgggagaccgactcaatttgattacccagttttatgcttgcagaaataatgaggccagtaatgataagagtgcctagtatgtaatgatgaagttcaggctcaacaagataggttcacaaaagggcaatcatgcttgatttatctgattgccagactggaaatgaaagaaaagcagtgacataattaccccagattcctcagacctcaaatacaatccagcacagatatttgcaaaagtcttcagaatgattgcaatgcattttaaagagggacatacatcactgctgtagcaaatacaagaaggtttaaaaaatcaaagacaaaggatgtttctggaatctgtattgcttgcaaacagaacaaaagagagcagggaaagaaagtcacttggtgagagaagaaaggcagaggattgaatcaggaaacgctgcgggtgcctgggttttgtgaccttggtcatattctttgggcctcagctttctcacctatgaaacaaaggatgtggactaggctaagtggttccatgaagccagtatttggatagaggcaaggggtagcagaattgatctcatacaaaagaactgtagtttgaatatttatgaaagcaaaattagctagtgattaaaaaatggggcagaaaggtggctcaaggagaatgcaaatttatcttaattcaaaatacagtataaaactgatggaggcgattctttcaagaaggaaaaaaaaaaaaagaaacatatcatctgtctctcaatttccttccctgtagtctcattctctcttctctgccatcatattttttttttcttgactttctgtttccagtaaccatggtgatgcttcttcccagcaaccttcttcacagctggcctttttggttctcatcgaattttgctccattcactggttcaggttgctaacaatgctgtaaaaattaacttatttattgacatttttctccttcccttttccccaggaaataaatgcaggaaattattccacacttaacctccctacacaagggcactgtaaaatagggatattcaactgctaatttcagttgctaacatggaggggatacagattatgccaaagattgaattctctgcctgggccctcagggactgaaaagccccaggaccaagctggttgccacctccttttgcttttgtatgtaaatagattgcccccagaaatcacatatcggccctggttttctaattctctgttttttttttttctttttctcttgtaaggaaaacatggccaagtgcataattataactgttaaaagggtattgaattttctgtaggaaaatatacataaatatatgcatttctttaatgaagatatttattttggaatataaataagcaatatgcgatagttaaaaatattgtaattatctgccaatgacaaaacatcaacaaatctctgatgtccttaatgcagataataaaaattcccataaactagtatttagtcatgtccagtttgtgtagcttaacttgtttgtaatcctatatgcctgaaaactgtttctctatttaagcggtgtgtgtgtgtgcgtgcgtgcgtgcgtgtgtgtgtgtgtgtctggcattaacacaaaggagaccagatgatgacattcataggctgatagactcgactcctggggacacacttggatggaggcaattaaaatgcctgtcaggcatttggtaccagaagcccctatggcaaaccgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctggtaatggtttggggcttttaattttatttcgtttcattttcaattcgtttttcataggatgtgctttatgtaatctcagagtaaagatcttttaaaattcattattgagcttcctaaatattcaagtactgcattttttttgtgctacagacctccaggcatagatttattatttgagtataaagaatgcatttgcttactggtgagttataatttttgatatttagttaacaaatccatatatatatatatatatgtttcttttgttttgtttcggtagattcttcagcttgtctctaaccgaggaagcattgattgggagctactcattcagaaaattaaaaggtaccacatgttttgtttggatgttttaatgagggaaaatcaggggagaattggaatgtttttatttaaattaatttatctatgattggtcttttatccttaagcttaagttgatcattgtctattgcatataccattttctatgcagatacttctattatctaaggttgttttgattagaggatgactaaagaattgtgtcttttgcctatgttgcaagttattaacaaatatcaacatgtttggcttatttggagattttatcattgtaatgttttttttaaagtccaaaattctccatctaaatgaaaattcattaatttgaatttaagagaaatatgctaagtaatgattttatctgaacaaatcctgctaagtgatttattaaaatggttaaatgaaatgccttgcccttcccaggtagaatgggtgctagagacgaaagcccaggaatgactcagtattgttggctttacaaataaaatattgtaacttctttattgacatttcagtctttaaaatggacatatttaaaggccgaggttgttagttcttaaaagaagttattttacatttgctttatttggaattgacagcataagaaagtaatccttcatcttgccatgaatgcacttgaatccacttgatcctgggcctcatgccttacatgaaaaacattaattttgaaattcagcatcaggatatatattgatttgagatggcaattatggatattaccttttctttaagaccgtctttaactttaatacctgttaatatcaataaaacctatatttgtaatttgcctttaaaaaatggaagacattttctgccctgctgagaagaaaatcagtaataccttttaagcctttccttgggatctatgtataatatttcctctcaagactgtcagtccgaagcattttacacaataaatttaatttttgaaaaatatacctgaaaataatgtccaactactgacactgaaatattataagtatgtgagtgtacacctgtgagtgtgaatatttgtagcaggtgaaggagagtaatacattgtcctttgttaatatctgcaatgtataatcatgagaaccttaatttattcattccacaagcacttcttaagagccttgctgctgtgggtaattattgtgagagagagagggaaggggtagatgacactgtcctcagccttctagagtgtaggcagcatcacataaagatttttgaacaggagaatgaattcgttaaaataaattagtgtggtctgagaaaggaaattgcattatttcagatattgaacaaaagctaatactagtcttgagacacataaaattatattgcacttcttcttcagaaattactcagtggaatcgtgtatgaaatcccccaaacaggattatttcacctagatattgtaaaactcttgagaccattctctctttttagatttcactcaaagtaagtgaaaatatttatgtttggtggaaaaaaaatctatttggtatttgcccatctgattaaatccagagagcatatatttcacatgaagatctatttcctaatcttcagactcattcagcaactcattatattaattttgaactttaggatatgtgtatgaattggaaaagggtgaaattatttaactgctaaaaaatgactccaatgcgttgtcaataggaactaataagttctgttatgatttgtctggatattggagaaggggcatacaatctcaccaacaggcctctggcatctaaattttggaggaccagttaaaaattcatctagcggtatgctgacaaaatgcatataataaaaaatgagtttattaaaatagtaggttgggtgattaaagcagaacagaatttgactactagagtcaaattctgggacctatatcatggtttttctagtcaatattgtggtgagttaattcctttactgatttcactcatttttttcacttacatttttaacacatagtatagtgcctgggtcacagtaggaattcaataaatatttatttaattatttcacaaataaatgaatttgtcagcattttcccctattacttttttgttcttgcctttcttaaaattatacactgtgaaacagacatctggtcattttttttttagttacccaaaatattcattacatgtttctaataaataataattagatcattacactggatataaaagtgacaaaccatgtatagaaatttctttaggctgtacggaataggatttttctggttttagattaaaacggaaagaattcttgaaatgtcccctttcactttcatcagctgggggaaatatgccaaactgcagcctgagctttgcttatggacgcttcctaaatactactcccaggcttgacattgtttattgcttttcatgtctttggccaagattttgctgcagcaaaggggaggaggcctttccccccatcccctttctataaatgtaatatgagaaatgatgtcatacttaccagtccataatgagcaacaaagcatttaaggatagatagatagatagatgatagatagatagatagatagatagatagatagatagatagatagaatattttctgtatatttaaggaatctatcaagaaacttctagaatcacatggctttagagaatgttattctttcttgctgtcatttattttcattattaaaagtataattttttgttattaacaatgtgacggacagtatcctaagtccttaacatatattatctcctttagctctccctgtaatcctgggagataagtgtggtctccattttacagataaatgaattgagactacagttgggcaaacccaagtctggcctcaaagtccttcatattaaacactaaattttaccacatttttttctagcagatttttggtacctagtcattgtcttgatgttccatgcaataaggttaaaacagtatgcttgcaaatatcttgatttatctgcaagtataaatcaaaatatctctatctatctatctatccatctgtctgtctgtctatctatctatctatctatctatctatctatctatctgtctatcctatctatctatttatctatggtagaagtgaatatgtcctcaaatacttaactaatattcaagctctattgtattttaatttttatatttaacttgaaggactttattcttcaaggatgaatgtcaaagataaattaggaagttttaaaataaatgtattcataaagcattttccatgtaattatagtgaaatgttattttgaattgcataatctatataagaaaattagagaatccaagtgctaaatagcataactgatgttataacttgcaaggtttgggttttttttttctttttaaagtgaaataatggcagaagaatgttcaagtgaccaaaataaagaaacaagcaggcaacagggccatgggcagagtaaaaataccaattcaacctcaaggacaactaacttggaaaaatcactgaagatactaacaattacacaaatatgtattaagattctctacttgcaaaggagtatttacaggagaacatttccggagctcagttggagtcagcaaaataagatgaggaagtagtaccaaggctcactggtaccgtaagagagacataaatgattttttttttttcagattttattttagattcagagagtacatgaaggtttgttacctgggtatattgtatgatgctgaggtttggggtatgaatgatcctgtcacccaggtactgaggatagtactcaatagttcattttcaactcctccttccttccctctgcgctttagtagtccccagtgtctattgttgccatctttatgtccacaattaccgagtgtttagctcccacttataagtgagaatatgcggtatttggttttctgttcctgcattaatttgcttaagataatggatccagctgtatccatgttgctgcaaaggacatgatttcattctttttatggctgtgtagtattccatggtgtatatataacatattatggataatttattaagggacttcattacagggcatgaattctaatcattggaatgggactcaacaggaaatacttcatagagtatgagttttctgaggcggaacttggggatgaatagaagtattcaagggggagacaacgtatggaggagctccagaaagaacaaacattagcaaaggaatcaaaggaagtgaacatgctgggaaagcacagactgatctcattcatattctagagtataaagcagaaaaacaggactcttagaagataaagttgtatcatacgaaatggctaatattcatcttttttgaattataaaattagaaaatttcattcagttcaacttaatacattgggagatggctttgaatgccagtcaaggaggtttgtttcttattcagtgggaagctattgactagtttgagcaggagactactatgaccaaactgtgttttcagattatttgttttatagctctgtgtgagataaatcagaactgtgtgtgagagcatgttgaagaaagcatcacttcagaagctgtcatagaataatcccaggggaaaaacaaaagtccaaagagggtattgactgtgggcatgaaaaagaggtcatgataatgaaagatgcttctgagctcaagttcatatacagagtagaacaattgcttgattggtaggaggaatgaacagcagaaggactcaaaggtgactctgaaatttgaatctgataactgaaaaaagcaaagggagaaagtagctgagagctacacgaggaaagagtccttcttttatttttattgtatctctagtcgctagcaaaatgcctagtacatagcagacagccaataaatgctaaatgaatgagtgagaacacgaataaaaaatgaagaggtatgtttaggacatgaggctggatatgtgggtggactgggctcgtagattgcagaacatgcagatccaaagctgagaagggaagtttagggagggagggcgtgggtgttattaacaagaaggataagaagaggaccagagggaatctcttggcagtacctgcatttaagatgcaaaataagggacaagaattaaagttgaatgaagaattaaaaaaaaaaaagcaaagaaagaagaggacagggaaggttatagaaaacaaagttaaaactcaaattttccagaaaaactgaagaatgagaataaagaaaatgttgctgggagtattatttatttcaataattattttgttataaaaacaataaatccacattttgtaaaatttgtaaaatttagaagggtgtaaggaaggaaataatagtcactcataattacacaatccagagattattgttaacacttttaaaacattttgatgtattttttatcctattgcttttaaaatttcataatcaaaatcataaggatataattttgaattctgccttttttcattcagcagtgtcttaaggatttctcacaacattttgccacctgcatattattctctcacctaaagtttggacattttaaatccctactgtttccagtttttcactatcaccataatgctgtagtggaatagtttgtatattactcttacacaatattttaaataatttccaatggatagttacttaaaacaaaatcactgtattctattttgtcaaattcctggacagataaaatttggtggtttcaaaatgagcctcggctttcctccaaggaggatctgagattacattagcacctgccatgtgccagcatctgtgaaaggcactttaattatcacagtatctctgatgtcgattctattatacccactttactaatgaaggtacacagactcagagagttgcacatgttttttaggcctagttttaaatctgggtctgactctaactagtcaaatcgtggagacacaaacaagatcttgagaaatgaatgagtaaataaggatatgaaaacaataggaaaatacacttaaggagtccggaactcaaagaaaagagagataaaatatgaaaagcaagaaggtagtgacttcagtgcgcttttgctgcttattaacatggaaaatcacaagccaaaggcaggggcaggtagagaggggtgctacatgtgtaatcagaaaaaagacaaatttatagaaaatgttctaaaggaaagggtataaagaacgtggacaagaatttgggcttggcatgcaaaatgtagcttccttataaataagagcaagggaaaagagggtgagacttttgaagtggtaaagaaaaaatatgagaaaccttgcatatctcatctggactttatcctggactgaaggatattcattcaatgaatattaattgaatacctaattccattcccgtttcctgcccttatggaactttccttctagagagtggaactaatcagtgggctaacaaataaaattaaaattactcaggcagctgttcagagaatgaattataaaagggtaagagtagatgctaagagatttgcttcttaaactttaaagcagagaagagtcaactggggatcttactaaaatgcagactcagagtcagtaggtctaaagaggggcctgagattctgtattttgacaagctcccaagtaatgatgctgctggtccatggagaccatgctttgattagtaaaaggctagaaggcaaatgtccaggcaagaaaaatgagaaatgattggaggagtggttggtgagcaagtctgaagtgagctcttcttattcagcaacatagcatacttttaaacctctttgatggaaagagcaaattgcctgtctactcccgagtttttaaatcccagccagttttatgaaaaatccattaaatcaacccaaatgagctactggcattccattctttctgcccattctcaatgcttattatgccatataatgaatttcggtggcttgtgtttggggacgtggttctatataaccctgtgtccgtttcttcattccagttctatttcctgcctcatgatttctttggactttaatgtcctctctgcctggatttccagtacagtactgagctgctaaattctctgtccccttagctcttgacatccatcacactcctctgtgggaagcttctgagtctccacattccatcctcttgccacccactcctactaaaagccccgggtgactctgcttaaagccacaggggaacagaagatagtctctgacttcaggaaagcatttttttttccgttgaaatcatctctttgtggtggactgttttggttggtgacagcaacctgcatccctctgagggatttgtcagaactctataggagaatgcatcggtgtgtagacaatcagagtgttcagaggagccaagtattcataagaagccttgacagactctgtcaggaggaatgttacctttctgcctccagtgctagaatgtaactctagtcatctcttttagctatgggaacgtgggagcactgacctgtttgattaccctcacatcactcattgtagctataaaatatctaagaaaaaaatcaaataaatataacatacccatccttcaaggcagagtagctcaagtgcatgttaaatatctgtggtgtcctcatccttattagcatttatcctttgcttaaggggctagttctctctctggaccatgccatgaccaggtctccagaccttgttatcattttgtaatttgttgtatacttaaacagccaaataggcatgagcaatgtccttagaaactagaaatttaaaattgcaatgaagtatcaaattagtttttatgtgaagtcaagttaaattgataatcacatttcctcaagaacacttaggcaaggtccttgaggagagaagccatgttaacaggcacctttgcactgtatatgttgtctacatagaagatactctagatgcacattcaagtcgaagctaagaaaaatgagtgttgtacatgggtgtgtgtatgtgtcagtctactctttccataatggacagcactggtcttctttgcatcatcaagctggaattgactatttgcagaatttgaataccatgcccatgcattcaattgttaagagtctcagagtagcacagaatcatctctggtcttccaagattgtctctctttctcaaaatagaagtctgagtaagttttgttttttgtttttgtttttgttttgttctgcaggttccatttcagtctgcctcagatggtttgcattaaccttttttcagattctctcctggtgttaatgactacattatgaccattttaaaaagccagatgtacattgatccacctatggcaattattaaggaaaagatactccatttaatgcattataaccaaaatatctttcttcaccacgtgtaggaacttaagaaatgatgtctctttttgggaagatcttacattttatttccaaggtgaacaatggttgtacttagttttctttaaaactattttcttgctttttatatgattttctcatggtaagatttcatgttaacatatacagaataaggtgaagcatgcaagcgttaaggattcttctgacatagtgcccaagagccaccaattaacataattttgaacataacttcaggaaaatttgtgatatttcagagtcttaaaaaaaaacctaagtagactgcctatactttaaatagtgggagcagaaattcctaaaatgattgactttccaagatgacatttgaggaaatatgagatctaacaatcgaaacattttaaaaatcatacaagaactcatgagcctgagaaattcacataattctggctgtacttttcctctgtaggaaagtggataatccaagagataaaagagaaataataaatgtaatatattacattaagcatgcaatgtttgcatgcttaatggaataagctccctatgttatgttcacaaacacaaccagggtatagactgtgaattacaaagttgttagaataatgcaaccagttaagaagctgcatttagattttaaggacaaaaaaaaataatcacttctgtaccacttttaagtaatatgaaacattttctaagacgtggtgttccaaagctcacaacggtctttggaatgggaaaggcagacattgttattatatttggtatagatgaaaatactgaagtttgaagaatgcaagtgtcctactcaagtcaatgcactagaaaatggtaaacctgggacacatatccttgttctgactccaaagcctttacttcctactactatgaagctaaagcagataaatgagtgtattgccctaaatctacaatattttaataatgcactgacttgattgctaaaataaggaatctaaggcagtggcgacctctactaagtggattgccctaccttaaaagactcctgcccttccaagtcttggattagtgtggcatggatttatgtaaatactagtaaaaatagcacagtctttactgaaatggtttaaaatttttcaacatgagaagcagataaagctaaatatatcacagaaaatgaaataatgaaatattattgatgtaaaacacatttgaaagaaggataaattaataattcattgttcagttctgagttccacagaattttaagcgaatggtaaataacgcagtaagaattcaggatagcaaagaaaattattaatgtttcaaaagagcacatctatggagaaacattttaaaacataggcattgtgatttgcctgttgttaggataattaaaagagcttataaagaaaaagtttaaactggatctcagttctggtctcagatgtagacatggaaggggaagaacatatataaagaaaatgatgacctcaggagctgctgagttagggtcaaggtggaggttaggtgtcctgaggcagacacccatgggaatgggtccaccaaggccatgctcagtgcagcgacccacctcttcctcagttctcctttccaccaccccatccatgctctcattagcacaccagggatactgaagtgtgtttatctggtctcccttccccaaacacatcactaccttaatcttccagacaaactagaacacccttcctattatttttttccccctttagtggctctcatttgctatctcaaacagtgttggctaataaatacggtagccactagccacatgcagctatttaaattcaaattaagaattttttttttgagatgagatttcactcttgttgcccaggctggagtgcaatggtgcaatctcggctcaccgcaacctctgcctcccggattcaagtgattctcttgcctcagcctccagagtagctgggattacaggcaagcgccaccacgcctggctaattttgtatttttagtagagacggtgtttctccacattggtcaggctggtcttgaactcctaacctcaggtgatccgtccaccttggcctcctaaagtgctgagattacaggtgtcagccaccatccctggcctcaaattaataaaaattttaaaaattgaaagttgacttccttagtcataccatgtttcaagcgcttgatagccacattctttttacagaacattatatattatattacatttctagtatcacagtgggtttgattgaagagtgctgctctggagcataaccagaaccttcacccaggcatcctaggcctaggcttactctcctccttgcccattacccttagcacacagtcttcactccacctgctactgtcctcctcttcatggtcattattacaattagaattaaaatagtaatgactcctgtttatttaatgcatattatatgccaagtacataccatgtttatgagattatgaaaaaacaaaacaaagaagcctcataagaccatttggtttctttgttttttgtttgtttgtttttgtttttgttttgttttgttttgtttttaagcttaatttcacagtagaggaaaatgaggtttagcaagggtaagtctgttttacaaagacaaagagctaattgtctgtggggcctgaaataaaacccaggtctgtctggcccaaagccaaggcttttcccctaacctgtgggcccctctgccggaagtcatttggaaatgtctggagacattttggattgtcaccactggagcaagagctactgacatctaatgattagaggtggccagggatgctgctaaacctcctacagtgaacagctttctgcaatagagagttatctggctcacaatgacaataatgcccaagttgttcgttttctatctccttctacaagaatttacagtctaaaaaaaataaaaatgaggacttttgtttccccaccacaattttcccactgccttaaacagtacttatcatagaataggtatatatttgaatgagagttgaatgtatcgtttttaagttaaagtaacacctacttatggtaaacaaataaaagtttaaaaacaagccaaacaagaggaccaaaagaaaatgaaagtcttcctctctgttcccattcccaatctcacatcccagtgaaaaccattttgataattgctattccccaagagttcttctgattaccattttagttgtaaatattatacttccatttcttaacttgggacagtatctattgatttactacaataaaaagtgagaaatttagcacactaacactttctccctctcccctctatttgttaggttattataatttttatattgtcaaggtttattatgaatgtattctgttctgtatttataattaagcaatctgtattttatgttgattcaaaaatattttgaatatattcaaaaatatatttccctgttgaatcaaacactgtaatcagaaccactgaaaagtaaaggtaatcttgtctcttcccaactcctgcttttcaagtgaaaatattctaagtgttgagatccagaggctttaatgccttttcaacctaatttctttcttctaaactgggttcagcacactttttctttaaaggggcagatagtaaatattcttggctttgagggtcatctaatcaccatcacagcaacttacatacacagtttctgtcgcagctacaatgtactctgtcattgtagcacaaaagaaaccatagataataagtaaatgaataggcacggctgtgtttcaataaaacattatttacaaaaacagatggtggctgtatttggcccacaagtcatgacttacttaccctcattttaggctatattcgtgtctcccagtgtcttctatctcatgttatcttttctgtatttccttttggtttgactggagctccttgtgaaaggcatttattcatatgtggccagtcactaataaatctgagtccttacttgttttaaactatatattcacatggtacttatacttgattgataatttgatcaggtgtgcagttttgctccattacattttagcatccagtgttattgatacattacattttagcatccagtgttattgatacgaaatctgaaataagtcaggttctcattcttttgtgaaatactttgatggttttctttttagtaggctttaggaattttgtgtgatttggaaatgatgtgtccagatgaaggtcttttttcatttaacctatttggcaatcagactatttttaatgatatctttttaattcaaaggaattgtggtttgctcttctttgatatttgttgctattctcgcctctgttctgtgcttagggtattcctaatgataaatatggaacttccagaacctataatgtctcctttttcaaatattttaagacattttttcactttttctccgttctaggttttttttcctttttgtcaactgaatcatcaactttacctttagtcctgctaattctatttttaaaaatcaattcaaattatgtaatcaatttaaattcaaattatttaggtactcatatattaatttccaagaattctttcttattttctgattgatacttttccataattcattttcaaaaggatgttcatttttaaagtatgtaaataacattctttcaaatctctctgagaaaaatacttgtaagttctctcttctttcctgaatcacctctatttcctcaagagtgatttttaaaatgtattgttattgtttgtgctgcttatttttctcaaatatcttgattttgaaatttttattttattaatttgtattttttaattaaaaaaatgaatgaagaactagttgaggatcataggtcgctgttgtaagttcctttgcagttgtgtagctgtgtatccccattaactgtgaaggctgactaatggttctaggtaagagggcagaatctgtcaagatgcaggtatcagcagcgtgtggtaactctcatctgtaaactcagcactttaggaggctgaggcagtaggatcatttgaagccaggagttcaagaccagcctgggcaacacaccaagaccctgtctctacaaaaaaaaaaaaaaaatatatatatatatatatatatatatatatatatatatatgtattataaaaaataatatatattatattatattttatattatatataaatatataatataatacattatattatattatatataatatataatataatataatacattatattatattatatataatatataatataatataatacattatatttatattatattataatatatattataaaatatatatttatattataaaaatatatttatattattaaaatatataagtatatatttatattattaaaatatataaatatatatttatatatatatacacacacatattttaaaattatatatatacacacacacacaaattagctggatatggtggctttcgcctgtagtcccagccacttgacaggctgatacgagaggatcactggagcccaggagttcaaggctgcagtgagctatgattgtgtcgctgcactccggcctcggtaacagatgaaaaaaaaaaaaaaaaaaaagcaggcatcccagagggagtatggagcaacagctggcaagctggcaatgagcagggtaagatctttgcacatccaccatgtgttttagttctgcctggatttatctgtattagaccaggttccaaaactgatcacatgctttcattaaagactagttcttattttgaagacgaaggcttcaagggtcaaatgtagtagcaagggagaagaagaagggtctcaaatgttctgaataagtttcttaatgaattgccatgatgttgctcccatagtcctctaggactctgtatttgattacgctaagcttggggtttcctcaggtttcttcagggtcctactattaacaaaacacgtttccctggtgttttttctctttctgtctcagcccgtctgcatttgatgtctagaatatcttcaaaatttctcctagggttacactgtatttttgacaattttattatttactgatacttaatagagagaagtgtgtgtaagaattctcctatcactgatcatatttcatattttttactctgaatattcataataacagtatatgtttgcactacaatcttttccacttattatttcattgttttacctctagtatttactacctggttggaaaaattcctttcctcggcctttattttctgtaaaataatgataggatctaattctcagtgttgagatggaatatacaagtacagattgtaagatgtagaatataaatgtcaactgtctttatatataagactttctcatggatccagagtaacaagtaaatgaagaccttgagattaactagttacaggataaccccttccctactgaataggaattacaaggtgatcccaaggagaggcaagaagtaaaactccttctacaattctaaagaactagaaattatatggtggtagcagtattaaaataagcaattgcacattggtatatttttcacctcacagaaagacaaagttgaaagcagaccaagaatgtagttaatagactctcagctaagtaaaaataaatgtgaaatttaggtttggcggtttggcgtagaatatatgacttaatgtgtgtgatccttgtcttggcaatattaagaatatgaatatttatgttaaaatgagtataatttagtggtgctaattagctgccacaaaactattattgattttatctggcttcagttaattgaaagtttctgctttctcagtgagattaagacatgaagcacccagtaaaaggagatactatctcacaccagttagaatggtgatcattaaaaagtcaggaaacaacagatgctggagaggaggtggagaaacaggaacacttttacattgttggtgggagtgtaaactagttcaaccattgtggaagacagtgtggtgattcctcaaggatctagaactagaaataccattggatccagcgatcccattactgggtatatacccaaagcattataaatcatgctactataaagacacatgcacatgtatgtttattgcggccctattcacgatagcaaaaccttggacacccaaatgtccaccagtgatagactggattaagaaaatgtggcatatatataccatggaatactatgcagccataaaaaaggatgagttcatgtcctttgcagggacatggatgcatctggaaaccatcattctgagcaaactatcacaaagacagaaaaccaaacactgcatgttctcactcataggtgggaattgaacaatgagaacacttggacacagggcagggaacatcacacctcagggcctgtcatggggtaggaggcagggggagggatagcattaggagaaatatctaatgtaaatgacaagttaatgggtgcagcaaaccaacacggcacatgtatacctatgtaacaaacctacacgttgtgcacatgtaccctagaacttaaagtataattttaaaaagagaaagaaaaaaaagaaaataaaaataacagtaaagtgacttcattgtaaaaattgaagaggagactaaatgtagagagaaagctaaggatcacagtggccttttacttcaacgtactggaaaccatttgcggatatgataaaatgtgtattttccctaaattattaaaacacagcatctttattgatagcctttattcttacgaataaactgaaaacacatcaaacagacaaagcacaccacgtgaatgtatgcagcatgatgcatctacaattagatatatgactgctattcattcttattttctgcatgcagttattacattctaacgttgactatttgcagaggataagtcgccagccctagttaaatgttaatggatctagtgacatgacatactttaaattcaaggccttatgcaaaggaatgtgaataaaatgcatttgtttggctttttatggccactattaaaagtaaaggaaatgaaaccataaacaactatgctcaaatattggcatagctgaggctgctttgttgcagtagaaaatcatatttattgatggtgaagctctgtttaacctacccagcccatctggatggtaattgaaattttaaaatgtacttggagacttaggcaaaacatgaagcgctaactcaaagcgagttcattttgatgtgttttaatattctgttgttgcaaaaagctggcacaatttacaagtcttttttctaactcatacctaaagccaataattaatgtagtatagattacttttgcccccagtacctattatctctttattcctcagtaaaaataggactcctgcttttgggagattcatgggtagttggccattcagaaaaagatccagaatttcagcctcttttgtaactagctgtgaccatatgactaagttctggcctgtaagctagaaaagaagttttgtgtgaaatgtgtatcagctacttaaatggagtaagtgtgctctttgccacttcttcctcctttcttctagtgggaattcagacttagtgactggagcttcagcagccattttgaatatgagataatcttataatatatttctattttgtttaagccactgttaattggggtttttccattacttacagccaaacttaatcatctgtttgacaattttataactttatgtttattttcaaagattccaaaccatcatttcatcatcatttctctgtatataaatcacttttatattaaaattgttaccaaaaatataccaatcagttaccaagttctattcagttccactttctaaccagtcttcaaatccattcatttctttatgctcacgtgaactatgttagctccgtctctcatcatcttgaactctaatgactgcaacagcttcctatatcaacccttgcttcacaggcaccattgtacacatggtagctggacttagtttctcagaatacaatctaatcatgatatttctgtggttaaacctttcaatgcttcccatagcattcaccctaaagtgcagaataaactgtgccataaggccatccatgatctggcctctgcctgactctctaggtccatcctgagttgatcttcctgcagctattgcattttttgttttttttgttttcgttttttggcctggtactctctctctatgctccctcccatctctccccactcccaccctcctcccctttgcttactgaagtcctgcttattggctgggtctcagattaagcctctcatcctctgttctgatttaggcttgaccattatatactttcagagcccctgtacttctctcacttatatttatcagattaatgcccatcttcctacaagactagaatctccatgagtgtctgtcctattcttttttatttatttatttattttttttgagactgagtcttgctctgtcgcccagtctggagtgtagtggcgcaaccttggctcactgcaacctctgcctcccaggttcaagtgattctcctgcctcagcctcccacgtagctgggactgtaggcacccaccaccatgcccggctaatttttgtatttttagtagagatgggggtttcaccatattggccaggctggtcgcgaactcctgatcttgtgatctgctcacctcggcctcccaaagtattggtattacaggcatgagccaccgtacccagccttgtgtctgtcctattcttaacttgaaccccggcacccagtgcagagactggtacagaataggtgctcagacaatgttgtcgactaactgatactttttttaaaatttatttattttatttatttattttattttttattttatttttattttattattatactttaagttttagggtacatgtgcacaatgtgcaggttagttacatatgtatacatgtgccatgctggtgcgctgcacccactaactcgtcatctagcattaggtatatctcccaatgctatccctcccccctcccccaccccacaacagtccccagagtgtgatgttccccttcctgtgtccatgtgacctcattgttcaattcccacctatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattggtggacatttgggttggttccaagtctttgctattgtgaataatgccgcaataaacatacgtgtgcatgtgtctttatagcagcatgatttatagtcctttgggtatatacccagtaatgggatggctgggtcaaatgatatttctagttctagatccctgaggaatctccacactgacttccacaatggttgaactagtttacagtcccaccaacagtgtcaaagtgttcctatttctccacatcctctccagcacctgttgtttcctgactttttaaagattgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatttattctcttctcttcacccaaaaagcatacctaactgacatcccaaccaaggttccactcatcaaaatcccatccatcctctggaccatcaaaaccatgtttgcaccttctccttttaattaggcattcatttttcttgtgatcatatatcagactttaattacagttattttgtttacaaaattctaaattactattgggaacacattctagaaaattcaagtgttttagaaaagttttattataatagctgcctgtatttaaaaaaccatttattacaattgccttcttgtcaacagaacagaaatttctggagtctatggctggtaaattattccttttttgcaagcagaatgtctggcatataacaggcatttaacaaatattgagttataatgtagtggaataataagtccgtactttgaaattggatacccttgggttcagatcctcatcaactgtgaaatattggaaatttaccacgcctcaggtgtataaaacaggaatgataataaaaaacttattaggatattgagggggttaatgaagataatttacagagaaaaagttatataattagtagtaattactatgatcttccaaattacattactctactcccttcttaacaaacaaggtaggtgctcagttctttcttgatgttgttttgaaactgaatggtaaagtttgataaagacaaagcctatcattaaacaaaagctaagacctataaaaggagcattgaagggactgcacagtttcctttactctgcccctttgcttctttctacccatttcactcttacccaaaataaaaacaaacaaaacaaaaaaagcccacacacatcgacaggtgaaaagcagcaagatgatagatggaactgtatattatccaaagtcaccagaaaggcctggaaattatatacaacctaaattacaccacctgaggccattcttctctcaggagaaaagctggcaggggcaatgttaagagttcagctgtttctcttgaggtttatctgaaatgcagatttgtccaagcctttcctagctgttgcagcctccagacccaccagctgctgtcagtccccccagctggcttaataggatttgtcttctctatagcctgtttccggggctgtctaccatcagcacatattcgggtagacagtttttccccctaactagtgtcaaaatccctaccaatcccccaaatggcaaagatccattatcacctgtctcaaagaaaggattattttttgtgctttctgcctctagccacatacatagatgttatcttttgtaagagtcctcagtcagtccctattaagggcaaacctccttgtagggctgacagagccaggacacggtgagtgagctgggagtcagcggccttgaatttgcaggcttccccaggtgttagcgctgctaggctacctgatttcaaatgcttcccttcttcttctctataggagtaatgtctattccatcatttgagctaggattgtgactatgtagcctttcctgtaggttaagcttacactttctttacatgcacagattcttgctcagttttttatggctaagcaagacacactgttgagaggctaatagcttgggtcagttcaggattagacttctcacaatgacagctgtatggctcttgtcaagttgctctgtaggcacaggtttctcaccagtaaatttcaataatacttacctcatagacttgtgaagaatggttgccatattgactgtaaaatacttagtcaagtgctaggcacttcaacatggacaataaatggtggctggtattctaattatttacggttatacttacatttaaaatttttatttttatttagtaacttaaacattatggttatgcgtagtcaatcctttcagtttttattcttttttctttttttcaagttataataatgtaggattttatttttagaacattttcatgaagaagtatctcattcctttctacatcttacataaaaataaattctcttgttaggcttaactccaaccatatttcacactttaggcatgtgaattttttaactagagagaaaaatactgtgttttaaagatattgaatagtctttgacatggaaaacatagctttaatggttcattgtttataaagagaacttctataaattatgtctgaaatgcagtgagcttgcaaatcaataggctataaaggggtggtcctgggtgtttttatttctttagtgttttcctcttgtgctgccagtaacttaccaaatgcataaatgagagaaatgctaatttattctgggtttcatcagtaatgattcttgagtctactacaaatcagttcttgggaggttgaatcacatgggttggcagtgtatttttctgtgatatgcgacatacagataggataaaggatattcagcattctaatctcccttgaaggagtactacttatatttttttaaattaatcttgatttttaaagtctcaccctttgtatctacaaaataaaagtaaattgccaaaaagactccacttaatgacatttaagaaaggaggctgtttacttgtgtgatatgcatgaactcttccaagcttcaaggtctgttttaataaagccctctttgcacagacattatgtgtgaaaagtctcccaaactaatttatgcacacctgactcaagcaaatactgttgttgttgtttttctaaactgcttgtcaccttttgaattttatctagtttggaaaggaaatcgaccaatatgccttagttttttagttcgaacaagactcaactatgcatattctttttatatttctctcaaatggaacaaatcaattctcagtcaaaaagaaaacagttgagggagttcatttactgtttgggttaaaaatataattggcttaaaagacaaatgtaaaaactattaggatttttctcttcaaatatatttggatagaattaacaaaggatgcaaaggtatacttggctacccatccagtcataaaataagtgctgctgatcatgaattgcatttgatttcacatgcttctcctcaggcaggctggcagtcaccttggcctcttttagctgtcagaaggattgagccttttgtaaactcaatagattagaatcccagcactttgaacagctggtgtaaataggaacacgaatacagaaatatattctaagtttctgttactaatcttgatcattaatatccactaccaataaaaagtacacattcacactgtgaatctattttgatgaactcagaagaagaggagccagctctcctgacaactgaaagagaccaagaagactcaagttcttctgagaacgctagcggattctgagcatgccaaaactggaccaactctccaacagagtttatcaaaatatgaagagctgcctgtgggccttgcggcacttctctaagtcaatattacacattataattctctaccaaatcttaaaatggtttcagagcttgtactgttatctggaaataagagctaggcttcaaagagatactttggtgactgcaggtctccggtagtcctaggaggaaggctaatgactctcaggcaggcatctcaagctcataaatcagtggcttgaagtgaagccatttagaatagaaaccaattaaccacaaatatcaaaaagagataaagcattcataagaaagaggattgccagctgtgcacagccatgttttcatttagctgcagtccagagtcaaactgcccttaagcttggagagaagaatagttgggtgaataggattgcctgtccaaactgacctgacgcccacaaatttagggggaaaagaaaccccttggtttatttagaactaaattacactgtggaatctaaaaaaatatgtaggcccagctattattttttctacctaccatgtttcccacgaaagataccttagaaaaccatgacactcactgataatcacagataaagctttaccattttcagtgtgccttcagagtcattgtttcatttgatgtagaaacttcggcggtgggatggggggcggttatcacaaaggattaacagattgtgcatgaacaatctgcccccagtgatgttccatttaccttttatatgtagaagaggaaagcaggcacggagtaaccatttaagcaagcattttcaaagctttctgcatgctggtgggcagctccttttactcaatagatgttaatagctaagaaggggttactcccagtctttaatccctgtgaggtgtgagatttctcatctttttatacccgcctttcttgaccacataacagaatagccatgacttttcacatttttgacagaatatctctcaatttttggaatacaatgctataaaagacatctttttaagtaacagtttcagtcttttcatcagaggaaagaaaccacaattgctcttagtggtttcaaagttgatctaactatctaagggctgtatgtgctctggtagggggaaaaaatgagaaaagtttgtgtaatgccaaggtaaagccacagtgtcctacttttgctgatcggaggaatgtgcaattgtgtggagggacattgcaaattctagttagctgaggattctgccttgctgacccgcagcaggtcttatcatctcccggaggattttgttttgcatcctgtgtgtattcactagtttgtaccagtttccattaatttatccatgagattcactggatctctatagcagtaagaaggattggtgccaacaagaaggctatagcttagggtagggcccaagaaagatgaacagatttttagaatgtttgcatttatttaatcacaacttcaattcagttttccaagtagttactgaggtgttcattaagtccgtacccagtacccttgaaacaagaatgccacataaatccttgtcttaatctgcactaatccagatgagctaatttggtagtttggctctttagttccctaaagtgaccttaacacagggtgtacagtgccctatctgcataatcatgaattgtagcaaaaaggtttttgctcctggtctaaagaaactcaccaatattcattttggtgatacatttgttctctaatatgaccatcagcagttcaaatgtaattagaactaagaaaagggatatcctcttaaatgtaaccaccttgctttctcttcgaagcctttaaaaaggatttctgtaaaacagtttttggtattttaaccgagtaaccctacagtaacagtctgttttatggaggtcttttcaaattgtacacataggcaggcccaaaccctgcgcacatgctttttgtttgtgcagagaatgctgttaagttcttttattgcttaagcaagaataacaaataattatcctgccataaaggaaaatactgataattatagtttgccaagcatgttgaataagcggacaggaaagacaaagtgttagtgttggcaaatcccaaaacagaatacttctgcagaccgaaataaactcccaattctaatggcctccccataaaaatgctaaaaactttagaggctgttgaacaaagcctgatggttatggtatattatatgtaaccacagagatgaagattttaaacatagtcagtaatttctcactgtgttttagttagtgcagcagaaatatactaaaagagtatatgcgtgtgtatgcaaatgtgaatacatcagatctgaaaaaaatatttatataaaggtaactaggctgttttagaaaacaattttaaaaatacagtttctcctagctactgttcattagtagtcctctcaacaaacgtatttcagtgagactcatttcactatcttagacagttttgtgtgacttttaaacagcccttatggaaatagatttattcaaaattagatttttggcagaaaatatgtacaagagaacctcattatctactaataattgttgtcacagaaggaaacatttaaagtaaatcttcctcaaacacagatcaagttttattaaaaacatagtgaaggaaagttggaggcaatgtttagtttgaaaaaataaagttagatcttataaaaataaggttattataactatgaatagaaatgcttgtattataattgcaactatatgctcattctaagacaaaggaatgaattgagtttgtttggttttattgagagtaacttccccacaagttttattagaaggtagttcaacatcctttatgccacctttggctttttcagcatgctccttaaaaaggctgtttgggtaaaaatatttaagcacttactcaatttttcctagattttaaaaaactattgtgatacagaaataattatttgttaaagtgaatattgtgcccttatccttgtggttttccctttttcactggtaaccggcctaaccatgccagatcttcatgttctcatgatttgcctgttacttgagtacctctcctccattgccttagacttgcaatttaaattaacagttgagtggtatcccatttgtgttgtgttgtcagatattagcatcttctgacaagtatctggaaatcaactcaagaggaaagaccttgaccttttgagaaagggtaaagttagtgttaaccgctggatagatagatgcatgttcatgtaaatacttattttataaatgatcagtttttttagtgactatgttcacgttatgatggggggggtgtagaaaaaaatttctccaatgtgtaaaataatcttcctcactcaaaatcgtatatcaagccttttctttaagagaacatccatttgattgataccaccagagaagactttaataaattgttcagtctttttttatttctggctctttcataaagttacttgaagactgtttctaaatatgtgtctatggttaaaaatataaaagaaaaacttccaggtgagactatttaatttttaggcactgtaaagggaagatgtttcctcttggtattaacatgtgaagaaagaatagagaaagtaggtcttgtggcttgcacctgtaatcccaccactttgggtagctgaggtgggaagatagcttgagcctggagataaaatttgcagtgagctgtgatcacaccactgtactccagccttggcaatagagtaaaccttgtctcaaaaaaaggagggggcatggaattggggttaaaaaatagagtagattcattctgtgggcaaagtctagtaaaacctaggtaattaacatctctctattaaattggacatatgaaagagctttagaaaaatctgtaccaatccattcttttgttttgatgacattattttgaatgtaataaataattatcacatttgatagttgagatcatgtttatgagtcatttgattttgcatatatgagccctgcttggagctaagtaactgcataattaaattttcatttaaaggaacaataaccgcagaaagtcaaaagctaactcaagtaacaggtggtaaatgtttgatatctgtattttaggtgacttcacagtaaatgaatagcattaatgatattaaatatatcattttctgttgtgttcctgttaatcttcagcagaaatatttattaactttaaatatattttgaaagtattttattgttaatgatgagaaaaactaatagcatctaccagttagtataataaggtaataaccacaaaactcatctactcaccaacatgtttctatgttatgatgtacatgtcccaggtacatttccaagtagatggcattctactttcaaatacacttgggaaccatataaccattggatactatttaacatttaaaacattttccaaagttgaaggtgttttgaatatttaaagtttctttatttcagtacttaaagaaacatagactgaaatactgggagaaacaactggttcactgactgcagaccaagatgaattagtcaagagataatataaaacttgagccaagggtcagttcatcccaaacagattttgaaagatggtaaactattccctccctctcagatgtcttcaaattaatgtttcatttgtttgtttgtttatttgtttgtttgagacagaggctcactttgttgcccaggctggagtgcagtggcacaatctcagctcattgcaaccgctgcctcctggtttcaagtgaacctactgcctcagactcccaggtagctgggattacaggcacctgccaacacacccggctaatttttgtgtttttaataaggacaaagttttaccatgttggccaggctgatctcgaactcctgacctcaggtgatccacccaccttggcctcccaaagtgctgggattacaggcatgagcgactgtgcccggcctgaatattaataccatgtggctgcctaccccactggtgtgcactattgctggatcctcaccagtgaggggtaccccttttactccagagtcctaattctgaaagccccagtcttaattctgctaatatttctaactaccactttcttattccttttgctagtcaaactcctctaacatgtccattcaatttattgtcttatatcttttctgtcacactcttttcttagcattttgctagatttcattttcaccctattatatgctggaaatgttttctgagagatctcctgtgatcatcttattttaaaatggaacagttgccttttactttttatgttgaatgacctctctttgccacagtaatgatgcagtagaaagaatgtgaaaacttgatttcactcttgactctactgtgcaccactgactgtgagaccttaggcaagttatgaaacatcatacaaagattaaatactgtccaaaacctgaaacaaagattaaatactgtacacatatataagaggatattattagtggctacccatttctccttggaatctttttttttttaatggagacagtatcttgctgtgtcacccaggctagtgtgcagtgacacaatcatagctcactgcaaccttgaattcctaagctcaagtatcctcccacctcagcctcctgagtagctgggctgctggggtgtgccaccacacctggctaatttctaatttttttgtagagatgggatctcgctatgttgtccaggctgggaaatctatttttatttgattctgcaatattgaattgtattgtttttactggcttttcttcatcctgccactctatcattggtccatcccaaaactattggcctatcccaagattcttgttccatatatttgacgaggccatccatttcaattctagattaatctttgtgaaacacaactaattatatcttagcctaaaacctccaagaaattcttctgtatgctgaaataaatatacattcctccaattaggattccatcccctctgttatatgacccctacctacatttccatttctatctcccactgttctctgttgtgtgccaacaacctgtagttctcattgcccctttgcttctgctctttcttcagtttcatctttgcccctcatcccctgcttgcccaaattatgtgtaactttacaaagctcatcttaaataccatgctctccagaataattaaaattgaatgtaatatattctctgattcacatagtccctgacacatactttttcttctgtgctctcaccctatactttgtgttaattaccatcccagatttgattatatataagcttcttgaaatcaggaagggtgtttcatgtatttttaaataagatctaagtagatgaggtataatttaatgcctaatatatagtaacaaatgtatattcattctgaatatacattttcccattgctcaggcttaaaactctgaaaaaaatcttaaatttcaaaaaattaatatttactaaattaatttttgatttttctatcaaaatcatgaattaacatatgtcattgggtcattaattttgtttgaaaataatagctatattgagtgagatataattcacatataaaaattcacccctttaaattaaatagttcagtgatttttagtgtattaacagagttatgcaagcatatccattatctaattttagaaggtttttatcacccccaatggaaacccatcagcagtcactcaatttctgcctcacctctatcctagacaacctctaatctactctctatggatctgtcccttttcctggacatttcatataagtaatacaataggtggtcttttgtagaaggcttctttcacttagcatcgtattttcagtgttcatgcatcattcactgctttttatggaagaataatattccattgaatggatatgccagattttattagttcattaatcagttgacggacatttaagttgctgagtcattgattcttttttaaactgaaaggaaaccctgtggttatttagtccagtatcctcctttaatacatgtgagattgtgtcccaaagtggtattcctagacttacatagttattgtatttcttattattttagatgctgggttggtacaacacatacattcatgtacttttctactcattctttcatatgcgtaatacatacttatggagcactaagtgtttatgatctgaataaacaaaaataattatggttcatgtcctcatgaggttcacagtttaattgggaataagcttttattaaataatcatataaataaacacaaaattagaaccatggcaagagctataaagaagacattggggaactgaccttgtcaaggaggatattttagctgtgatctatggataagcaataattacctaagtaaaaagggtagagaagagcattccaagcagagcaagagcacatgcaaaggccctggctataggagcatggcttataggagaaatgacagaggcaaggtaacaggagaggagagggtaggggaagcatgtgtggaatgaggctggaaagtaaggttaaatgatgccaaatcttccaggacaagggaagggttttactcattttctgaggagtattggaccactgaagtattttaatcctagagataatgcaagcaaaaagaaaatgtgtattgtttttacttttttttttttctcccagggcttagctgtgttaagaaaggcgaaatttgctggatgatacgttatcttttctgccaaaacttgtggtagaattgtggcatttcaagttttcttttatgtgtttaccaaataacttgttatcaaaagtaaaaacttgtattattttcacaggataaacagcctccttattagaattctccaattcaattttgtgaagaactattctttccagttctcctacggaataagcaatcatggctacttaagaagtattataataaatatataaaggccatatgtttccattatacaataaacatgttttagacctataaattctaaaggtacagaaaccattctctaaattccaattagctaatgcctaattctttagcctaagtgcttttgacttgagagccattcctctcaggcactatatgaatgggacccaggaagcttttgtagaaataatataaagcttttgtaaaaaataaaggtcatgcctgcatgggcatgaatccaaagctttcattaaattctacaaagagtctattatacacacaaaaaagttaaaaactagggtttttgagagtggaaaataatctataagttactaggaaaaaatatttggtcactttttatactacttagagaagtttaaaccaatgcagttacaaatgacgccaaatatttaaactaacagctattatataagctaatatcttgaaagcagtattctcttttttaaaaattatagaccttagatcatactcagggattatattgagcacttgtgaggaatgtagattcctggacccactacagacatttggaatcagaatccctggaatagaactcagaactctggatttttaaccaggatcccaggtgattttggtgtcaacacatgtttggaaaggtaacatagtaaataacaacattctttctctgttcagtgttttgaaaaaacaaatttatacaattcattagttataatagtaccatgtaatgcacactgaaaaaatatatatataatataatttacaatttaaagatgaagaaattatggaccaatgaaattaaataattggccacatagagatctggctttgttaatactctgtcataaagcctcttgctgtaactgctataagttacctactgctagttccgtactataagaagtactcaggaaaagaaagcttcttttagagagtggagttatatgagtccataacagtgttagtcaacatccactgaaacccatgatcatcaacaaagttaaagatttataaagaacaaagtataatacatgagcctctctcaccaagcacaactgtctgacactttctaaaagaagctctcagaggtaacactttacaggcagaaaaagtgtgaaaatgagaaaaatttgctccaagttgttacaatttaacaagcagggagtataaagaaaaaacaaaatattacagtaaagtaaccctaaaacctattagcgtgtatcactaccaaaaataaataagtggataaataaaactccatgtaactccttaaagcagctggaaaaagacaggtctgttaggttgctttaagacatgagctttaataagcattttacccaagagagatggctctgtgatatgtgtgtgctgtatcacatgaattgcgtttcatttcatgcagcgcctttattgggcattaataataaaactgctgaatttaaaaacaaattctgaaatcaactctattttatagacctttactagaaaagagctctttgccaatataatgtggtctattcataaaatatttcgagagtgaaaagatagaagttttctagttatttgtttatttctagtttctagttataattttgaaatgtttgcatttcagtaatgaagtcaggggttaaaaacattcaatttgactttaaggtggctttatcacaagaacactgatttcttctaaaatatcttcacagtttatttctttatgaaaaaatggttttaattcaaattatttaagagaaaagatcgttcctttatgtaatgctaaaaaccaactcttcaggaaattgggagccagaatttttttctgggcctgttgtagctgagtttgtcagctgccatataacagcagaaataatatttcttatgatgctgttgaaaagtgctattcagccagcagctatagcaagtaatgtattaaatgaatgagagaactattaaatacattatttcaagacttttaggtgatgctatagctgatcaatatttgagaatattttgggaaatgaatggcaaatgtcttttttggtcatgagtcaacttctctatgacatggaaacatagtattagaacaagttttacaggaaatcttatttaagagcagaaaatgctataacttcctttggatagttaaggatccttatcttttggtttagcagtggcattatgttttcttattaacacaataggaatctgtattcctggttttagtgttatttcaaagttatatcaggatctaatgaaacatggcccattcatggctgcttgctactgtaataaattcttggagactattgctaaaattaccttctattagatcaggttctcttacccccgccgtgcgcatcagttgatctccagacaatcagtgagagtattttcagagcttgaagtagacttgctgtgcatagggaaagcatattctgtttatgctaactagacagaaccacccaaaacatgaggcaaagagaaagccacaaatggcttccagtctcttaacgtgttttttatttctatttttatttatttatttatttatttatttattttaatctgttttctatagctgcatgagttttcttttagctgaatggctctctgtttggaattaacattaggaaatagaatgaatgtgaaatggcaaaaataaaatcataaacaaaagaaaacaaaactcactaaactataggatctgtagtccttcgttaagaaagtgcctccaaaatcttccttagagccaaagcccctgctaaaggtgaaatcatgcaagtcactagttgccgtggggagcacacagtgcaggttgctggctttgcagttttgggaaggccccagatggatggatcaaggagctcagtggggctagcggagaagagctctacacttggtgtcttggaattagaccactgaaagactcagagtgggacttttttattgtagtatagttattcagagccacaattttaaaagataaaacattttgaagtctgtcaactattcattggcttaacatagctctaaaaaacattctaacagtgtgaggttgaaacctacctctgaagcaaacttttgtgcctgcaaataccaaaggtagctgatgtagtcccagacgagcccagggtaacccaagcaaggagtcaacagccctcacattcctttggaacaacaataattagagcagctggaatatttgcaacctcattggctcacttgctgtgtttttaagcccaggctttaatcttatttttatgtttttgtataaatcagactcatgtggcttaattatagacattaagtggctactaggagctttagatgaaagcttttcaataccgtgcaatgcccgggttctctggtgtcctccccactctgcagtttctgtctctttgtgcccctcctcctgtgttgatttctgcactcctccttcctccattccgactgcccctcatctcagtggtgcctgtttacttaaatctaagccaattaaatacaacataataatagaacatctttctgaaaagagcacaaaggatggggaattgcatggccactgactgaataacagaagaacgaggaaaacatcttaaaagaaacccccaatagatgattcatctattcttcctttgcctcctatttatagggaggcagcctcttctttgtttttgtttccagcaatctctatgccaagtcccccatctttctttggtagaatcttaatgatatatcatcatgtatatttccaagattattgatttgagaattatcatattatgcactcaggaatatggttatagaatttccagaacacttgggagtgataacattatagatcgagatatatttcaaggcttgcttttatgttgatatattttctgagccagtaagtaatattctcactcaattaagagaaactcactttttaaaatgcgttattacaagcaatcgctttagtaataaaatgttggctgccactgttaagaaaataatttggggaggaagaaaagatatttcacattagtatcacagaagggggaggggagggtgccagcttagtccccactgtgctaattaagtgatcatgcattgcctcttgaacaacatgcagcagaagataaagaactcaaatcagctggagatcacccttaattgtaaactcttccgcaagactccagtgagtcgatgaacttcctctgcttctagagcttttagcttttcatgctaaaagtagatttgtcagaatttcatttttctgctcagatgactgtagcacagcctgtatttccctctctctggtgtggtcccctttcctaaatgcatgcctttccaaattatccacgatcaggaatgtcagagggtgtggagctcaggcaaaaaacatcatcagtcagctgaattccagtttctatagaccacagctggaatctgaatgctcacgttgacctcaaaaatagcctggtgctctgtcccctgtgttcagccgaatgcctcttcagtgaaatctctgtatgtggctgcaggttgacagatggctcccagcaggtgaactcaaggctattagtgagtgaaatgcgttctttctctgccacaatccttctcaaagacaacctcatgtcttaagaaccttacaaaaggcttttagatgttaagcaaaactcaagagaagagttgaagccaagaaaccacagattaaaataaccatagggtttctgctcaagttaatacctagtttcttcatgagataatacagtagtgctaagtggtaaaagaaaatatcatttaaagactgatattgacactttgcaattttccacaattgtcaaagcatttttccaaacatataactttatgtaatccttacaatgactctataggggaagtctcattaatagtcttcattttgagagtggcaggaggcagccaaatgcctaggcagatacaggcaggtccccggtgaaacgccacctccaagccgaagacagtaaaaagcctgaaagccaagctacatgttaaatcctctgactggattgagaacttgtgttcctgtttagtgcgctttcctctgatttgtgcctacccttcacctattttacatatacctactctttcctaattgatttttctatgctatcatgccctcctttgagtggtatcttcactttaagcttttctgcatactcacaaaccaatcagcacacactccccattctgagttcataaaaggcccagacccagccacacaggcagaactttcccaccttcgggtgagggcaccatttctcccctatcccacatcccctgtccactgaaagctattttcattgctcaataaaattcttctccctctccacgcttcaatgtcctgctgtgtatcctcattcttcttgggcatggtacaagagctcgggaaccaccaaacagaggtaccagctataacacagctataaccagcttgtggccttggcacacacaagcatggcctagtgaggcccaggtggggcatcactggcccggggtccccagcttgcaaagtgatcaagaagaaaaatcctacatcaattttattgctaacagtgatgatccaaaaagttagaaggcttaaccaatattacacagccagtaagtgttcaagttcagcttctatatctaaagtttgagttctttttacttcaaagaccaaatttgattaattcctagtcagaatggttaggaaaataaactacgtcattcattaactcattcattagacctttactaacccacttacaaatcagggaagcattaagcagggtatagcaagatttcattgcttataacagaggagctcatctacacaaagttaaccagtactgagcacacctttccattttttgcaatacgtctctcagctgttcattcattggttgaatagttactgaacaagtatttgctaccaaacaaggggtgtagtgtaataagaaaacagtcagtctttctagagtatacacattagttggggtggagtggggcagacattaaacaaatacacaatatgcattgttagtgatagtgtctgaaaatagacagtgggatgagtatgtattagtctgcccagcctgccataaagaacaccacaggctggggggcttaggttcagtgaagcataggcagccatgtagaaatatggttggacaaaaaggatattatctcataattatagactaggcggggggacccagcaagacctgtctgttcagattcttcatggcctctgtgcaacattccttccttccattaaacaaggtagatcaaagcatttctttatggcaaattcttacacagaaaggcgggatgggggatacagtgtggggagtcataatgatatttttaggttttatggctgactttgggaaaagagggctctggtttctatgacccaccttaaggaacagggattctagtttctatgacttgtgttggagaagaatgaggcctagagatagacaaaaggacaggagaagatcagaaagaaactgcttcctaggccttcattttgggttattgttttctgagccccaacattagccaatgagcagagtgagggggttatgggtgaaaaattaccaagaggcatcaagtgtaggttgattcttgccaaacctacctaatcagattcttgctgaaggcagaccaaagacacacatcaaagctggaggataagaaactcaatcagatacccagcgtgatcaaatgtcaagggtgggggattctctctaaactgattttagattcttgctccaagaatccaaaggagccaaagtcaagtcttctagttaagaagagagctcagagaagcctggctaaagtttggtcaaggagagactctttgcttctttgtgctcatggaaagaaaaggagatctggtgtctcctcctcttcttataaggactcagtcctgttggattagagccctatctttatgacctcatctaaccttaatcacctccctaaaggccttatctccaaatgtaatcacgttagcagtaaggacttcaatatatgaatgttgggggtgggggaggatataatacagtccacaaagggtataaattaataactcttcagagacactttggcagcattgtttgaaatctattgtgtacgtatatggtttaacatttttttatcctgcatatgtttttattttaaattcaaaatgctatcaaaaagtagtttacatatttaataaatactaatggcttttagaattgaaataaagaaaaaaaaaggtcagggacatgaatttcttacaatttcatgaagccttaattaactatatattgtagtttacatgaatatcaaataaatataagaaacgagaaccatacatcagtgaaagaaacattcctggagtggttggggaatcgaagagttcatggagaacacttcagttaaataaggagttgaaaaatcaagaggaaggaagagacaaaaggagcagaggagacaggcagaaagaaagagaaagaagaggaccttgcaggagaggagaaaaatacaaagatggaattaataggtctgcaaaagaactagtctaagaaaatgtgagggtttgtaacagtagaaagttcaggatgaatacattgtagtcacaatacaaaagtccttgaggctaagctgagaaatttatattttgtcattttgaaaaaataattttgaccatgagtgctactaataaatcactatgtggtatcccggcaagataagtcttacgacaacatgtgaacctgctcaatttcctttgagcctctctccaatttttttctcctaccacatgaacctgggtacctgcattaatttattctaccattttttaaagattggtgttctgtttgaatggctgttatcaaaaagacaatatataagtgttggagagaatgtggagaaaaggagacacttgcccactgttgatggaaatataaattagtacagccattatggagaacagtttggtggttcttcaaaaaattaaaaatagaactaccatatgatccagcaatcccactactggatatatatccaaagaaactgaaaccaaatgtcaaagagatatctacactcctatgatgattgcaacattattcacaatagccaagatatggaatcaacctgtgtccatcaactgatgaatggatcaataaaatatgggatatatacataatgaaatatcattcagccataacaaagaaaaaaatttgcaactacttggataaacctggaggacattatgttacatgaaataagacagactcagaaagacatattcctcatggtcttacttgtatgtgaaatctttaaatgttgatctcatagaagtagagagtagaatggtggttatcaggagctgtggcagtgatgttgggggtatgctggggagatgttgctcaaagataacgaagtttctgtttggtaggggaagtaaattcaagagatctattatacaatatggtgactgtagttaataacaatatattgtattcctgaaaaatgttaacagaatagattgtaaatgttctcaccacaaaaaatgacaactatgtgaagtaatacatatgatatcaagcttgatttagccattctacaatgtatacatatttcaaaacatcatattatacatgataaatatatataattttatctgctaattgaataaataataaaagtttggtgttttgtatgcaacttagagacaaatgaacagatggctttctgtcaagtagtgttacatttcttcagctatattctgatgctgagcagaaaacagcagtgtagtatataaataagcaaaaatactgatacatgtgccccattgctgctcaacgttccctatattacagtgccaattcatattttatttataaaataaaatatttgtttatatgtatatatatttaatcagagtcagcataagctaccaatttagcaaagtgagttttaagctgatatcaccaggcattgttatttattttcaacctttgtcaacaaggaagaatcctaacatagctacaggacccagcccatcatacccattcatccttgagatggagatatttattgctcaccagatatcagatatccatttatcccccatgtttctccaccccttgcatttaagcaacatgttcagtacagtgggctgtaagaggaagtgatgtgtgtcacttcctcattaaggcatttaagagcctgtgctcagccctccagatgtcttcttttgctgctgctgtaatcctgaaggctgtgagttgagccacaagaaggatgtacctagagagctctgtcactgcatgagagagaagtggcctggagagtcttcctactcacatcaggatttgtgtaaacaggttataacctttattgtgtaaagcctctgagacttaagccttacttttctgactaatctaattgtttatccttcacctacttgtatactatttttactgccttgaattatgttgagatgcttcagacaagactagatcatttctactaaatcagcttaacccagcccgttagtcctctacaatagcctggagcttctgggtttagagatgaaaggagataattcttactgtctaccttacccaagttctctgctccactgaagaccatatgttatttgcataggaatttgctaacagctcttaatcctttcaaattatattttgaaataagtttcctttgcaagaaacataagtttctcttaaaaggaactttgacaaaagctccaagaaagaaagatcattctctgatattttcaattatcagtgcctttgggacaccatgacttccttctactcacaaatatgtagataactaattctataataagcacattagggagtagaactggtttagtagcatgttagactaaatgattttatgttggcatctgctttcctatttaaaagactgcttgaataatagatattttcccaactgttttggacattcagtcttcaatagctaaaatattgttatcctggacaagtgcactaaattacatgaattgctcaaaatcttggtaggtcagattgatagtggaggtggagtacaatgttattgttgtttatttgagaattgactgaatagcttaatgctagtcattgaggttaagcttagcctttagaaacactattcggaggccaggcttggtggcttacacctgtaatcctagcatcttaggaggccgaagtagatggatcacctgaggtcaggagttcaagacctgcctgaccaacatggtgaaactctgtctctactagaaatacaaaacttagctgggcgtggtggcacatacctgtaatcccagctactctggggactgaggcataagaatcacttgaaccctggaggcggaggttgcagtgagccgagatcacgccattgcactctagcctggcagcctgggcaacaagggtgaaaccaaagaaagacagaaagacagaaagaaagaatacaggattccagcaacttcaggcatcttgatttttttttttttttttttgagagagagtcttgctgtgtcacccaggctggagtacaatggcacgatctcggctcactgcaacctccatctcccgggttcaagtgattctgtttcctcagcttcctgagtagctgggattacaggcatgcaccaccatgcccagctaatttttgtatttttaatagagagggggttttgccatgttggccagactggtcttgaacttctgacctcaggtgatccaccctcctcagcctcccaaagtgctaggattacaggcatgagccaccacgcccgactgatgttttgcttatctggcaaagtctatcaaacatgagatttaaaaactaaatgatacttacaatgtgtttcgaaggaaactaaagagtatatcctggctcaacaatccagggaagattttatcttgatgactttgttgtttaataaaacctgagttcttacagccgttgaggaaaccacaacatggcaacattttctccaggagactctgaaaatctgcatgaatttatcattatagcctcaatgctgtaggtagcaaataacttggacataaatatgagaacagccaaacatatatgcagcctaagcacattgcatgcatatcttattttacggagtaaccagctaataaaagctgacttcgtttatagctgaacaagtattttgggttcctcattaaatgatttactcagcttactttgtgatgccagtgtgcagtgtacatcctattctctgccttgtgtaggctaactcttaaatataattgttaagcagttgactttgtcatgtgttgtaagtcatgattctcaacagtgttcatatctggctctaaaaggttctggaaggtagcataagcacacctggtagaaataatggaatgatataatgggaggcagaactgtggctgagtatactacaatttgttcaagaagctgaatgtgctgagtaaaaaaagtactttgtaggtaattctagtaaattaaaagttgccatcagtgtaatatcattcctcagagaagccacaagcccttaggctcaaaattgtctctagccagagttgaagacctaaaaccaattctcagtgtctgtggagttggtatgtagctaaaagatttgggcactttctagccttgtgatgctgggaaggacacttaaactctcttggcctgttttctcatttgtaaagtggggacaataatagaggatgatggtgaggaataaattacttaatatatatgaagtgcttggatcattgtctagcacacaataaattatgtataaatgtttgctaatattattttaggcatgttgcagccactttatataatgaatctaatgttaaaactatgttgttaatgttgtaaaaaaattagtgttaaagtaatttaatgctatttatatgggtacaaaggatcacttctaactatcctatgttaatttaaaatttcgtatgccttgtggaataggccataagttgctctttaaaaataaatccctgagagtatgtatctctttctcataaagtctagaaaattatagttatttctattttttataataaacaaaacctcataaaagtcaagcttatgtgaaaatgggccattctttttatgactgataggtattgggtaccctgaattttttaataatcgtctcatcctttggccaataatttcccaattcttttgggatgaaataagcttttaagtatttagggttggaatttcactttcattcatatgtaactactgagttaatttttggaaagactaaaagacaggattttttttagtgttgtttttaatattacccaaataatgaacatgctctttgataacagataggttaaatgttttctgtaaatggccagatagtaaatgttttgagctttgcaggccatatagtctgtcagaatcattcaagtctggcattatggcatgaaagcagccatatacaacgtggaagtgcgtgggagtggctatgtgccaaaagcactgtattttttaaaaaaggcagcagcaggatggttctgacccatggaccatagtttactgattcatattttataaaattcattttttttcttatttttactagggtaaaagacatacacatagaatgtgtactcacacacttatccatatgcatatgtgcttacttaaaaatcatgaagatgaagcacaaaaaacaagcactttaagaaatttaagaaaaatacataatttcaagagaaaataaaacagatattctatccagcattcatttgttaagtacacaaagactctttctatccaaataagctccagagctggcctaccattctactttagttctaaaaccaacttagaaggtttaatttgctaataatcaaaattgtccttaaaaattctctaaatagtctgaagttattgtgcatagaactctgtattatactgttatatatattccaaatgtgagaaccactgagctggactaaagaaaaaaaaagctatatgcaaagatttggacggtcagacctttctttttaaaatagttatcaaattattacagggaatggagaattctaccatgtttcttcttgcctgcagacatttttaaatgtttatttaaatgttaagacattctaactttaatatgtactaataggacttgtttgctgctgcacattgtgtgtaaatattcacagattaaatgagctaacacatgtaaaagcacttcatacacagctctggcccagaccatattttttgcttttgaatcaaacttatgtctgctcatatccatatacacattggtccttagaggttcatacagaagaattgagccatctgcatcttgtctttccaacttgcatttcctagtgggtcttaaagaagagttaataggtgtcagagtttgagtctgggttccttacctgtagagcaacatcttcctagaagatatgacggggtccactctaccaggagtaaaatcacacaggtcctgacaaaacgcatggagatacatagatttagatacctagtataagagagctggactataaaatggccctcagctctgcaatcccttatgtattgtgcgtcctttgtagtcctctatagatgaagatagttacacctgaatggcttatgaagtagaaaacaagcctcgtgctttctagtaattctgtttatttctacataccacttcagtaagaagtattctgtattgttctaggtggagttcctaagcagaactgctaatccagaatgacatttaggattctgaatgtcaaaataagtttagtactccatggagaaaatttaatgagttgttaaaaaattcctctccatcctgtgctggagagaatcaatgcagactgggctggaggcccagtcctttaaagattactggatataattaatgatttactagaatgaatgtattctcttgggagaaaatatgattgtctgctatttattagctgaagacaatttaaaaatttattctcccttggatgtaatacctataaagtgccattggagtggttttcaaagtgagaaaaagcatgcagcagttagcattttcacttttctattctatctgtgatagttcccagccagtgataaatgctcagtgtatgaccactataaagaaccatgatgatatccatctcatagtcttatagttgccagaagagaaagccacaagatgaattctgttgttgagctacttgatgtgattaatgtatatggatcagggattaaactattaattttctatttttttaacagaaagaagccagaaaatattatcaaccctttgagaacacgacacaacgaactttatattttaccacttccttgaataggtaagactctctctactctgaaagagttacctacaagtgtgaaaaataactctttgctaaccttttgttttttaaaatctttaaataagtaacaattcattttagtaatggagaaataacttataaatagttatttctaatattttaatagttatagctaataaattcagtgttattaaaacagcacttcatagtgttgagttgacttaatagtaagaaaatgacaagctctttctcttaaatcaggattgaattcagcctgtctctcctgccttggttgacaatgccaacggtatttcttcagtacctgttacatgccaagcatgatcctacatgacttaatttgcataaatcaattcatttacttcttacaacagttctatgacgtagatatggggatcatccccattttagagattaggggcatgaggcagagagagaagcaggtggatgcagggattcacctgagattgcatacatggctttggaagcaggcactggacagaacaccagccccagctgttattaggagagtagtttcatgttgtggtagaaatgtctagcaatcagactttcctacattttgagtagtttttatcaaaatttatggaataaaaataacagtgcatttactgaacgcgctataaatgcatagcagataaacttttatgtttgcatttgttcctcacaaaatttttgcatgagtaaataaaggaatatatatgctttagctcagttacaagcagaaataatattttcctttattttacatctttctttaaactcaaaattcctatgataaaagcataataaaattatggaaagattataaatgaatgatttcttattctaggaaatatatttcaatttagtttttttaaattagaagtactgaatatataatcttaaattggccacagcagtattcactttcttgtttttattatttgtttttaagcaagaaaatttataagatgttcaaagcaaaatataaaaaaatattataggccgggtgtggtggctcacacctgtaatcccagcactttgaggccaaggtgggcagatcatgaggtcaggagtttgagatcagcctggccaacatagtgaaaccccatctctaccaaaaatacaaaaaattagccaggtatggtggtgggcacctgtaatcccagctactggggaggctgaggcaggagtatctcttgaacctgggaggtggaggttgcagtggctgagatcacaacattgcactccagcccaggtgacagtgcaagactctgtctcaaaaaagtatatatattacagcaaatacctaagcatccaccacacagattaaacaaatgctaacatgcagctatattaaaatcttgtctaaaaaaataatcacagaagtcatcaaagctcttcttgcttcctttttagtttcttccattcttccagagatgtcaaaaccctaaagatcatataaccttcctgtgtgtgttctaacactgctatgacatgtgtaagaaacaaatgttgaacaattattaacattttaaaagtttacatgaagggcatcacactgtagatattcttttgcatctcatctttacccaatattatatgtagagattctttcatatcgaggcatgaagatctggttgacaccttctgttataaagttgactcatcttaatgttttaatcttctggtgcctagtattattaattattatttctaaataactttcagcattttaaaggtttaatgttaaaatggtttaagcatggcttgcaaaacttatttgagatttatgtataaggaattcaaagtttttaatatataatatcatgccaatcctgcttatgttttatttttttcaactagaaaaacatttttttatttggtttgtaaggatcttactaatctaatgggactcatgattttcattcttttgctataacacaataattagaatctgttttatttccctatacatgaaacacttactattcccaaatatagtataaattactacctttggaatttaagatacttaaaagtgaaatatcttggtctggcctatgttagttgctcatattctagaaaataatggaggaaactaaaaaagaaattttttttcaaaatgttttctaacactatagctaattttagaatttgtttaaggtaaaagaaatgttagtatatggtagtgaaatagtagacatagactctctcccaacttttattttctgagagaagtaaattatttcgtcaaagttgggggaggaagaggaatagaagactaacctttttgggcaaatttgagtaagtaaatttgagattttatataagtctcttaggtcagaaatgcattaccattttgcataggaggcaaataaggcccaaatacctcaggtaacttactcaagatcatataatgattgcagagcctgcattcaaactcatccctttcaggctctgaagctattctgcctaccagaaaataaattggaaaaacctaatctgtttgtcacatatatagaaattttattcatgccactaatatttattgggatccttttatgtgagttgaggtccagtgttaggaaagcaaggaagacacagtacctaaaatgagaaacagtctattgaaaaccacgaagattaatttagtgataccactaaatgtgactatttaattagacatttttattttgctgtgatatcctcacactgcttaccaggtgattacctttgaaattgcctagccatgccaattcaattaaactggataggataataggagtgaaaatgttttgcaaatgacaaaatctttgcaatcatttgctaatattactaattctcatattccatgaatttagagttgaatacttctatcctaacacatgtacttctaaatgtgtttgaagtttgagtcttactaacttatgtagaattcacatatttttcggccgggcacggtgactcacgcctgtaatcccagcactttgggaggccgaggcagacagatcacaaggtcaggagtttgagaccagcctgaccaacatggtgaaacccccgtctctactaaaaataaaaaattagccgggcatggtggcacgtgcctgtaatcccagctactcaggaggctgaagaaggagaatcgcttgaacccgggagacggaggttgcagtgagccgagatatttttcacacaaaaaccttaaatattacagtgcagtggttagcaactctgaaagtttgtttgtttctaacaaccaccacctgttaaaggcatgatttaatctctttaagactcagagtagataattacagtaccaagctcatgcctgtccaggatcttatcatgccttatcatctctacctatatcattcacatccactgtctctcatgtttactactatcataatcccctgtactcagtcttgttcttctacagtctattgttcacatggaagtcagaattatcttttaaaaacatcttaatcaattgatatgactctcctatgcagaatccaccaatgactgcctgtaatagtcaaaaataaagcccacactcctacaatggccaacaagatgctacatatactggcatcttctacctacatcatctcgacatgatctcctctcatggagggcagagactatgatgttcagagctgtattaccagcccctagaactaccacctatcctggtggatggaccctcacttgctgaagggatgactaggtatgcaagggttaccatggaacaatgtaggtagatgctctgcacacagagtacctttaatgcagaacagtgatagtcgttgcccttttaaggattcctttggtttgtttcaacagaggccatcacatctgcaatgctaaagcactttcatgtttttgactcatgattttatagcattatgagaaactttacttagctgatttataattgcaagccataatgtataataccaaaagaaagaaaaatgcacatagacaaatcaggaactaattagctggatgagaaagccagttgaagagcagaaaatatttattattccttgcagtcttttaactaaataataatactaagatttaccacattcaacatagtttagattttactttatcttcagaatagatttatatctcttcatcactcatagatgagcaaagtttatcctttaagataattttctgtaaaataggctgggtttttgttgttgttgttgttttatttttataatattcctaggagaagcacttgatgagtgtttatatcattgagaacatttggcaagagaaagacaaacagtagaaccacaataccccaacatttaaggaaatgagaaagaaaacctggtattttcaccatcctctctgaaaataaatactttgacttgcactgattactacttcatcagcattcaactccgctccgtggcactctgtgtgaataattttaaaggcagattaagcattctaaaaataaattctattggtaaattaggatatcagatgcttccattataaaagcctatcctattctgtactctcagctggcagtcatatccagatctcaagctactctggctcttattgaacaagaacctattccaggagtgaggttttgaagagggatctctcatggttaactagagacagaaagaggcagaattgcccacatactctggcaggagttaaaataacaataacagccctcctacttaacaggctgagtcatcagcacattctactgatttctcagtaattctgggcagattgtttgggctggaattctgtaggcagaggtgggcaccacctgcttcaaaaggctctagttcttattaggagggtgctgttattaagtcttgtcttttaactgtttgaccaaatggagataggaaaagaaaacaaaaacggtgctgatgagcactttttctaatgcttagaatttttaaaaatggtggtccaggcatggttactatgcaattagttcttttactggctataagtcactttgcttaagcagaatagggaagattattttatggttgctgagggacctcataatccaagggctcagaaacagatcttatgagggtctagaatcaggaactaaacatcagccaggaactaaggccaccattctcccaatctctctggggctcctcagcccgatccctctgtagctctctttaattcaagatgactatagataactctttacgtagagactggatttccctactgcccattacacaagcacaactctcaagtgtgctttctcatgaatgccagcttcaagcagtatattaatttttaatgacctgagctgcttagctaataagctgtgatcaatggaatagaccaggtggtgcatatatagttgccaggatcctatacctatgggtgggaagagggaagaataatcagtgaaatggagtctcaaaagctattaaaaatctcatggtacagtttatttataccctaagtcttcccttccacaaaattcccctttattgaattttattgttgtataaagagccaaagagtaggatgttaagagattagaagagcagggagtatagccagcctccaagggaaagacaaatggataaaggacttcttgactgtggtttttgtgtaattgatactttagggagtgttcactacatactattttttccttcttcttcacatacttaggtatattttatggttgtcaactcatgaaaaccctattactgatcaagggtcttccatattggttggtgctcagaaactgaggatgtttataagcccttaaaagtcttattcaagctctccttgtcccttgagctagaaagtagcatttttcaagattgaagggagctacaagcaaaaaaaaaaaaaaaaaaaaaaaaaaaaaagagagagagagagcgagaatagatggaaagcaaaatgactgtcatagacaaatctagagacagaacaagcagcttaaggaagcatttcaggtgcaaagttagcattcagcctttagcttgccacattttcctgtaaaaataaaactgcttataagatgcattcatctgtctgtcctgtccctttgatgcaatatgaaaaatgtgaacttagcaagagatgtgcgggtatgtgggtgtctgtgtgtttacatgcacaacttaaaccaacgtttcagtacacatagttccaaagaccactcttctacaaaacttggcatgaatgtgattatgagtttgggatgctttaaaacctcagtcctatggtcattgaaacgaattttaatttgaggatacagtgtgatatgaggaactttgcaggcagacccttcagctactgtcctgtggacctggctgttcctgaggaggtgaatggccattttcccacaagtggtatgtttggccggttccccttttgtccctcaggcttctgttgttggcaaaaaaaaaaaaagtagttaacaaggaaacatttttcttaatggtcataatctaactgcagcataatacctgcctaattctcactgaaatatgaaaccaaatatataaacttattttcgagccaatcatcattttacaggagagaaaagagtatgtgatgaagcaaagatctttctatttactcattaaaaaatattttaatcctaccttgttcaagtctctgttctataaagcatgagaaatccaagtaagggattgtgtagaagcatgaaactgcaacatgtgttaaaagaaacagcaagtccattttaattggattatgtaaggtagtagactgagttgagtcaaaaggggtaaattgaaataggactgtggagatgctataaaacctaacctaggggcatgcactttattcattagatagtggggattccgtgggcaacacggtttctggcagagcaatgatgtgatcaaacttgagttaggaagtttgattacactggcaaagatatgtagaatgaattagacagtagattctgaagcaaaagaaaattggaggtttgcatcactaatatgtatttacaccttcaatatgtggcagtggacaagaaagtgagtggaaaagaaacctgtagctgaggataacagtcaggactggaattatggactaggtactcatctacatatccagtatctgaactatttggagtgaagggccatggagaagagaataatgccagaaaagagcaaagaacattagggaacattcacattggtggggagaagtggagaaacagagaaaaatgagaaggatatttagaagaaggaatcatgcctatcatgaaccaaggttgttattacagaaaatgacatttaagtcaagaagaaagaacgaacaacaaaaaagtgtcatacttcgtgcttaatagattctcagtgactattaagagacaggaaaacaacagtaactacaaagtctctatcttcaactccagtcctgagaccaccaaacacaaagtttctaccatgctctggccatgcccatccagatatgctgtcgtcagtcatcacaaacacacatgtccctctgtgctcttcctggcacccaaagttttaatgtatctccgttgctatccatcaagatatccaagtagaaatccaagaatctattgtttaatcctcttgctttaattcctaaatctggccaggcaccagattctgaagtatctcagaaatctgagccatcctcttcctcactcttactctctcagcccagggcgtctaccagaacctttcagtggcctttgattagtttccctcttcctgaaattctttataaactgactctcctccatgctgtcactgtgtaattttcagtgtatatcagatcatttctttttcctacttcaaattttcctacagtctaaagctccaaacatattaaatgccatttagaacacgtcaaagcagctgtttctggacaatctccagtctttcctttctactcgattgccttttcttcattctaacctcagcaggtgacttgtacttcctcaatttaattatttatttttgtatgccacgtttctctcatgttacaatcacctttgttatttccgttactcctgtctaaatacccgtgttccccttgtctgccttccaaaagcctatgtctgttcaattcaaatgccattccttctatgaagctttttctccagtcctaaaaaagtggtattaattgtgcctttaggcaataaggggcatctggtagccttttaaatgtatctgcactatagaaaaatcatcttggcgtgtcattattcccatccagttggtgaagtctcaaaggcaaaagtttcaccgcttccaaaaccatgttattcgattttaaacaaaacaatacttaataaattgttgttaatagttgttactaagttatgagtaaaataatgagtacgtgataagtaaatggattaaagaggtgaaaagaaataaactgtagccttgagatagatttacaaaatagattttatggtgatggttactgtttgtcatcctttcgtgtggtagggaagggggtttgttttgggtaggaaaaaagactaggtttgtagtcagaaagcaagaaaaggaggaagaatgagctggaattgtgagaccatgaagggatatatgacaaaattttggaggaggcaggaaaagatacgttaaagagcaaataaattaacaaaataagggccacccattcctctaaagaaaggtgacgacaatgagggcaaatgaagagggcctagagagacaagacatagaccctttgcagggcttctgttttttaccatctcaggaaaaggagggctttcactctgcttttggcaaacatcaagctgtcctaagattccctgaatgtgtttgcacattctgtctgcacattggccagaaagcagatgttacaaaaggaccaacccagaagctgggccatctttgctccagccacaccggagaagggcatgaagagagaaattcaggaagagctgcaggaaattctttcctcaagtttgctctctcacttctcccactccacctcccacagggtgttctagttgctgtcaagatttgctgtgcaggcaataaactggggacagtgacttaaatgtttcatttaatcctgctacttctattagtctcatcgattttttggaaaatctcattatacttttcttcaaaccaaaaggattagcttattgctataacaaacagatctagaaatgtgttataactttgtttcttgctcacctaacagtccaggttcagtgttccagttgaaacgttgtttgtcctcttcgtagtcagccagggtccagacttcttccatgtgtggctttgctttgtcattttcttcatccagcgagtggaagggaaaagaccaaggaggagcaaaaggcagctgtacctgaggtgatcttggaagtgtacacagcacttctttctgttcacctgccattggtttgaactcagtcatttggacacacctaatcgcaagggaagttaagaaatgtactctagctatatgctcaaaatcaaaaaagattttggtaaatggttagcagtctctgttataccaagggaaaatctgcctacaaattaatatatttgaatactcagatcaagtagctcaagctgtggcaaaaatagatgtcagttataccacagagataagagtgtggattgtaacttcaatatcatgttaaaatagtaaatgtattaaatacactagtttatcgaacttaattcttataataatagagaaagcaagcattttgcttgggcaacatagcgagacctcatgtcatctcacaaaaaataaaaataaaaattagctaggaaggttgcacctgcctgtagtcccggctacttgggaggctgagatgggaggattgcttgagcccaggagttggaagaagcttgagagagctatgatcatgccactacactccagcctgggtgacacagcaagagctctgactctaaaagaaaaagaaaataataaatcagatattttacataactctccttatagaaatactcattgtttccaaaatgataatgacttcaaaagcatagtgtctattgccattcttggtttcttcagtaacttcttattaaaggaatcaattgattaattaatgtagaaaacctcattatggaaaaaataaatatttgtactttaatgagtttctaaaatttattataaaaagacaaattggcatagccagttaaaaactcatttttgtactgaagaaggatatatggccttttaaggaaaaatgaagagtaaaattataatagaaaaaaaccctgagttgatgcttttgcaaaaatgtttaaaaaactgtgatgttttgatgaacttacaaataaccgtatatagtcctgacgtgatattttgtatttgctccatccatactgtttatttggatgtttataaacattactatttacgtggagggtagcagtgcacctggtttatatgaaaggaatatagtgtgttgcagtgttgcatgaaagctgttctgttggataaatattctacaaaatcaatttatctgctaaaaaaattctataattgggtttctgtttcctgtgactgcagaatgcttgggtgtttgcaaaaatactgcattgcagtaagtgtgtgatcactgttttctccctgaaagttaaaacgcattttctctttgagagtaggcggccatttaatagaattctcatgacatcagagagcatttcaaagggaagaaaactggcctttcctacaagcatgtaagcaaagacagtttgatgttttcttctatgtgagattaagtagccagcaagaccccaatgtggctgaactcaggggctgattccttctgagtatctctgtcaaatcattcttcctaagaagtgtgatgattttacctaaacctagtaatttcttgagatttttactcttttcttttatcacccaccctctgcacttttctaatgaatatcaaggactccagttgtaccatgtgctcagtaattactacagaaggcagtttgattctgagacagttgtagtctctgtcagagaaatttagaattcactaaagcaaatacttcagtgagggagtgccaaagcttgagtcatttacaaccattgtgaacagagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaaacattctaactttattttctccacaatagtttaagtaatgacaagcctatcctgcaattattctttctggcatccaggatctaccatgcttaagagcctacaaagacttcccagcttgtataggatcctgtagagcttcgtcaggtgaatttttgaaattatacattaaaagtctaaaaatcacagaatgccaaatgaaagctcagaacctacctgaatagtattctctacaagcgagtgtactgctgctgtattctgcttttctcagctcatctggaatcccagaaagaaaaggagcagttctggccgggtgtggtggctcttacctgtaatcccatcactttgggaggccaaggtgggcagatcacttgaggtcaggaattcaagaccaccctagccaatatggtgaaaccctatctctattaaaaatacaaaaattagctgggcgtggtggcaggcacctgtaataccagctacttgggaggctgaggaacaagaatcgtttgaacccaggagtcagaggttgcagtgagccaggttcacatcactgcactccagcctgggcaatagactgagactgtgtcttgatgagataagacaagataaggtgagaggagataaggtaaaataaaataaggtaagatgagataagataggatgagatgagataagataagatgaggtgacataagataagataggaaaagaaaagaaaaatgggagcgatcagtccacagtggcccttttaaggatgctgttaccagtaatacttctaacctaaccatcagcctcactggtccctttttctcctcacttactacagtgattaaaatataaaattgctatcctttgttattgtgatggttatgatgaaatgttaaacatatgttaggtttaatagaagattaatttttgaataccagtgcattaaaaaattaatgtctccttaaactttttgtgatttttctaaaatttgttttattttaatattaacttaatcttttttgtgttcttaataatttttttaaattcactcttggctaggtcctatttacctaacttgcatatgatgggtctatttttatatctaagtattttgcctacaggcccaccacataatattgccacatctattaagacttttccaaataagattggaatatttgtctttgcagaaaaattaattattgtggcaatttaagtacttgaatattttttctagctcaattttttaacgtctcataaatgtaaatgaattgtatacatttcaggcctggaggatttagcaaatgtatgtcccatcatacccctccagaagtttgacagaatacaagtagcatgccatggaaatcaacctgattcctagaattcactctggggcacactaagataaatctactcaaagagagaagtcaaacagtatatgaaggctgatccagttggatcaaacttgggttgcaagggaatttcagatgacaaggattctctgtatgcttccttttggcccaactcaactgatatcatgaataaggctactttcaacttagaattcctctgaatcacaattacagctgcagtgggcacagcacaacacaagcagcctgccccaaatccacccctagaaaaaaagaaagaagagaaatgactctgctttatatgactcatacgttacttatatatgactaatatttacctttccctggagaaaaactagtatttaacataattaactagatcgttgatgctccacagatgtagtaggttagtatactttaaaatgcatgtaatacaaatgttttgcatccatccatttttctttttaaatatgtatgactcagaaggtttttactcatgtagtacctattttatcctctattattgcatttactgtgttataatgtatgttttttcaaacacatctgcctttctgaatacagtgtaagcagtttatggtcagagtctatatcttaatcatcatcattttcctaatgcctaacagcattcctgatataaacctggtattcaatcaatgatcattgaataagatactagaaaccaacataaattaatcgatggattgataatgatcttaaaattaaatgaaggcctgatacatgctcattagagatcattatcaatccattaacttatttattttgctttctagtatataattcagtaatcatttattgactaccacctttatatcaggcccagtgctttggtcatttaggctctctgttgcttaagcaatcctcccacctcagcctctcaaagtgctgagattacaggcatgaaccaccatgcctggcatcagcacaaattttaatgaaaaggaactcttctggacatcatatgtgactggaccacaaactgaattcaaaacataataatgtcaatacccatcaaaattgtataaaacatgatattttatcattcttttcaaaacatacatgtaaatagatgatagataaatactgtaattcatgaaacagtctgttaagtttattagactgtattaatttgaggattaggttttgttttaattaattaatttttttgaacatagaatctagccccttgtttcagtcccactcacactgccatagctcaggcccagttcctttcaaacaactgtctctgagaaatgtttctatccttagccatgtcttcttccaatttactttccataccactgctggatcaatcatcctaaaaaccaagctcgagtgtaccattttcttttctccatctttcatgggcatccatggccttcaggacagagtgcaggcatggctcaccacatccctttacaattctgccattgcctggccatcgacctcatttccacacttcccacttcacttctgttccatagtgaacaattttgtgccttacatgaggtttttttttttggttgttaatgttgttcatttatttagcgagcatttgttgtggagcctactctgtgccacacactgtacttggtgctggaggtcagagatgaattaaacacagcccttcctccaggagctcacagccttgtgagggagacatagagtagagaggaacctctgacccagagtgagggctggagttatggagatgccagaagatgctcattttggtatctttctagaaagtgttgcctagcccaagtctcaaaaacaaacaaaacaaaaacaaaaatgtaggatttggtcatctaggctctttcttcctagaaagcttcttgtcctttctttgactacctcctacttgtcctttaaaccctcttccaggcagtgttgattggcttcctagtgtggcaagagatgttgacgtacctccacaacttcccgtccttatcaccatcacagcatgtaccacactgtattattgttattggtttgtctgtcacctccttcaacatgagggctatatatttttttctagtattcccagtgtgttcctactacttgatacacagaagcctgtccattaattttttaaatacagttaaaaaataattaattgcttaatgcattaaaatttgtaatcttagagttggacaacatcttagtagtcatacattccagcctcccatcagtcaaaaccagaattgattctataatgttcataacaggatggtcattcaggttttgcttgcttgaacacgttcactgataaggaatgcaatcaggttcaaagaaatgcaaaaaaaaaaaaatactatgactatgctgtaaatctgtttacacttatatttggaatgtgattttaatttgaacacgttagagacagagctttagtcagatggcttgcatttgtggagaaacaattgttcatcagaagataaagggactgagcagatcccataaagagaagggcacacaacaaatggtatcctgcttataattctccaggactttattcttcctctgtcttaaatagccaaaaagccgatcccactcatagaaaactatcaagcatctaatttttgaatttatgttctaatacattctccagtttcaattatctattcttttttttttttttgtcttttcatgactgccatttcttctccaacttttagagttttgttttctcttaattttaattctagcatcttcttccatgatgtataatatggcctccaagtttacctggatcatggccctgttacaataccagaaaatctctaaagcatctagtcctcaagtactgattgttatttttagattgttgttaatcccagccagtggcttcttcataatgtggctctcaggtatctcaaacccaaggatcttcactctgtggtggtgcaaatacttatggcctaaattctgctttgtaatgtctgcaattctagccaatattcttcagagttgtgtccaaagaagatttacttttatggtattttgttaagtgaacctggaccaagtctgacaggtcttgaatcagattccacactggaaaaagtttaaaacaaaatacattatttatccaaatccaaattataattttcctcttaagctttttatcctgatatttaaatgtatgcttatgtaagaaaaatttttattaaaattatgattagaattttttctccttataaagaaaaattctaatgtaggggtcaaagtttatttgttcaatggctccatagttagttacatacttatgaaactaacactctggtttagcatcatgtccaagtttacgtatctagtaagcggtagacccaggattcacccctatttttctgattgaaaatctgttacttattccacaatatctccagtacctaaatgcaagtccttaattccttaattaaatatcactggtaggggtggggggacttaaaaaaaagaaaaaaaaattactggtagagactaaagctctaaagcattttaaatattgtttatatctaatatacaggagctatttattagtcctctgatataataaaaaataggctcagaaatagtatacagctgtgaagcataagttgtatatcatggtcacataaagacaattgcccagtttcatatggtaggttgttaccaatcgagcaggtttacaaagttagtgttgttatctggagtggattctctttttagctctaaccctattccaccagtctcactgctttgtgaaacagcaagcaatggaacggatgttgggatttgacttctccttccagatctctctggaagtgtctaatttggttaaataattgtatctattcttggtttttcagtgtgggtcaaaccatgtactgaatcctattgctgaaaattttcaaataaaaaccataaaatgggctgggcacagtggctcatgcctgtaatcccagtgttttggaaggctgaggcagaggaattgcttgaggccaggattccaggcaacataacaagacccatctcttggtggtggatgggggggattagctggctatagtgatgtgcacttataatcttagctactcaggaggctgaggcttgcttgagcccaggtgtttgagactgcagcgagctatgattgtgtctccgcattccagcctgagtgacagtgtgagaccctgtctttgaaaaaaaaaaaaaagaaagaaaaagaagaaaacacaaaataataacaagtagtaggtaacatttcttaagcccttccaacttgtctgaacttatactttatttgtactatctatttctagcaataacctaatgttatctgtgcctatgatcatttgaaattacgtgttatgcacccaccagctctcttctttctaattgtttattagtcatggtatgtgatgaagaatgatgagtcatccttataggtattttacaatcagcctgaaataaagcagggaagatatgaaacaaatatctggattttcagcatatctttttcatgttatcaagaaccttttcctctgtttttcttagaagacaaagagggagaatatagagttgcaggcagcttattaacaaatgtttaagcttagaacttctcagcatttataagcaaaaatatggattctgcataaacttctaataccattaaggaccaaaacaaaagtttctattttgtgatactgatatgcatagtaacagtataaagcataattgagcctacatggaaaagagaaacaatatttatgtgcttaattgtattacacaactggtcattttagccttttgttcatctgtggatatgtagcagcacaaaattataaaaccaatgtttttgattgaactggcacattacatgatgatagggcagaacacatagaaaacattctagaactgtctgtgccgaacacattattaaaatggagacatgcctatctggcacatagtgtatttttcctttagattttccaagactttattgtttctccttttgccaatttttgagagtagttagtgctgcctggtaataactatcatcagtaagtattcctgtgctttgtgatctttctaatattgtaatccaaagaaaaccagtgaggtttgtgattatgtgggaatcccaggagggaaagttctattcttcttaatgatattttcagcacacatgtctcagtgatctagatactaaataattcaattacttctttgagagctttacaaattcagagttatctaccacacatttgcaccctgcttattaccccacatccacctccaaaatgatctaatggtaaagaaaattgtaactcaatttgagatattttaatcaagtgtacttctatcacaaaccattaatgaatgctaaggggtgtttaaagtaaatgttcgaaagacgatttgaaaatgccagggactgcccattgttttcataatgtgaagtagattttttttaaccatggacaattggtaattttaaacattcttggaagatactacaagtaggattaggcacaacagagcactgccttattccccataagctagaatacgagcagtctatcttgtgatttaactccatcaactcatcataaatgttctggacaaaggaagtgaaagacccaacttctatttgtgagaatagtcatgtgacctatcaacatagttgccttaacccttcacttcagttagtctatagggatgttccatgtgtgtatttttatcactcctcattcttttctgaggtcctatgcagcaagcttggctgaaagcactagtcttcaaatgtcaatgtatcagagtcaccctattgagcttgttaaaatatcaatttgcaagtcccacattgagaaattctaatttgttaaacctgtgttggagctaattgactgaaaacactgtaagacacactggaatggatgatcaccaaagatcacttcagttttatgattttaaaacattttctccaatggattgaagtagtttatcttaaaagtatttctaaacctttatatcatgtggtttctattatgattactagacctctatcaccccatttatacagatttagaaatgtttttactagaccctattcgtgtccagtagtttgttttacttggtgttatttttcatatgcaccggagcatatgaaatggagttagaacttgaattccatacttctaccatgacagccctgaaaattagattcaaaactattcccctcttaacccaatttgctatatagtgttggccaaacatccacagcaggcagaacctttctgtgtttaccctgaggtaggtaattgattaattaatattcattcaacattgaatacatatttgaaagctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccatgtgcaatattcaggcaatgcaataatagatggaggtccaggtgaaaatgcttctctttttaagccagctgttaaatgcattaagttttaatttgtacatacagttttataacacttagataaccaaccaaaatatgttatttggctgtctccaatataataagtcatttatcattttaaagttattattcacttattagccacatttgcttgaatgataatttaaaaagtattccaaggaagaagaacaaaggagaaatactttaaaaaaaaaactaagtaatttattccaacaaatcagatttttctgctacagtctgttaacctgtaacctatctgaaaggtctaaaatattacatttttatgagacattttgtgtggaaaatattgttgcctattttgtacttcattcgctttacatgaaaataagctattgtgtgctaaatgatattatataattctattgtaagaactatgctcaaactaaaatgttaaaaggtaatatgtacagttatgtatttatgatatatattctgcaggatttcagaaaagatttgataactttcacaattataaataaggaacagaacatagtactcaggacttagaataaagtaaatactgcattaagcattaaaattcttgggaataaaagaaaataagggaacagatgtatttcctgatagtctaattatcagaaatatgcaaaataagctgggcatggtggcttatgcctgtaatcccagcactttgagaggtcaaggtggatggaatgcttgagcttaggagttcaagacaagcctggacaatatggcaaaaccttgactctctaaaaaatacaaaaattagctgggcatgtggcacatagctgtagtcccagctacttaagaggctgcttgagaggctgagcggggagaatcacttgagcccgggaggttgaggctgcagtgagtgtgattgcatcattgcactgaagcctgggcaacagagtaagaccctgtctcaaaaaataaaatgaaataaagaaaataaaagaaataagcaaaatataggttatcttatttctaaattacaatgtaaattaatttattatgcattttttttgcacgaggcaatcacatcacaaaagacaatgtttcaacagtagtgttacagatttgcaggcagactttggctgcctatgggcaagtccaaattttttcttaacacagaaaaagaggaactcatttaagtatctagacacatactcaagtaagattttagaatttttaaacatagaacattacaatcttaggcctggaaaatgctaaaagcagatacatttaaatataagaaaatcctaatgcagtagaaattgaattgttgatgttccagtcaatactgtagaaatctgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttcattcttttgttgttgttgttgttgttgtttcttcctgttttttacttgcttctcaatctcttctatcacttctgtttctttagaattaataaattctaaattaatagaacatttggttacttattattccattctcacattgctataaagaaatatctgagactgtgtaatttataaagaaaagaggttcagttgcctcatggttcacaggttgtacaggaagcatgatgctggcatctgctcagcttcggggaggcctcagaaaccttacagtcatggtagaaggcaaagggggagcaagcacctcacatgaccagagcaggagtaagacagagtgaggagccacacacttttaaacaatcagatatcatgagagctcactatcatgaggacagtaccaagggggatggtgctaaaccattcatgagaaaaccacaccacgatccagtcacctcctatcagtccccacctccaacactggcaattacatttcagtatgaaatttgggtaggaacacagatccagaccatatcacttataaaattcataattcatggtaccaaaaccttttaatcaaaatgaggcaaagtacttgttttactcaacagtattaaacatgtaagcattaagtctacctaaaaacaaaattgaagaatgttacatgtgttaaaaagacgagaaattaattcatataccatttcaacttgaaatttaagctctagaaagaccattctattctggttatataacagttttattatgctgatatactatgatacagcttaaatcatcaatatgttagaaatctgatcaataccaagtctcttagtttggctcacatcattggaatcaaaggttaatgtcagatcaacaaacactaaagaatcttcgatttttcataattttccatcagtgaaattattcagagtgcagcagtgatcagtggtcagaggttggtatgaaaacattcatgttgttgtcaagaacattagcatgaaaaaaacagatctaaggtttatcaagggaaaaagctggaattttaaaaaaccgaagttttagcttttgatgaagtagaaataaatgtgtccatagaaactctcaaatatcaagacaaaattgtttaacaactaaggtagcaaacatcaaagctcaccactcagattcataactaacatttctggtggcacaatattttttcttttttttaataatataccttacctagaaagaatacttgggccctttaatatatagtataatagtcataatacaataaagtcaagtgtaatatctcaccctgatatcaatagatgtttaaacgtcttggatttttttttttttttttaacgcagtctcactctgttgcccaggctggagtgcaatggtgtgatcgcggctcactgcaacctccgcctcccaggttcaagcaattcttctgcctcagcctcccaagtagctggaactacaggcacacaccaccacacccagctaatttttgtatttttcttgggacagggtttcaccatgttggtcaggctggtctcgaactcctgacctcatgatccacccgacttggcctaccaaagtgctggcattacaggcgtgagccaccggtgcctggccatgtcttggatttttaaaaaatgcttatcacacataacagtattcccattatatattgacgtgtgttttgtcctaaaaagtaagattcccattgcaatatattataaattgtaaatcattgttttagtcttagatttccttgctcacattatcaagctaggcttttcagggaagagaaataaggcggccaagacggtgaaaccccttctctactaaaaatacaaaaaaaaaaaaaaaaaaaaagccaggcatgttggcgggcacctgtaatcccagctactcaggaggctgaggcaggagaatcacttgaccttgggaggtagaggttgcagtgagccgagatcacaccactgcactctagcctgggtgacggagcaagactccgtctcaaaaaaaaaaaaaaagaaagaaagaaagttgtttaggtagcatctcagcttgctctatcaaagctgggattgtgtggcagatgctcagctgtttggcagttaggagcagttaagatctgtgatcttttgcaatttggagagtttcccattgtacagtaggaatggaatgttaaaaattcctagtatctcacaacaaattttttagtagacttggagagaatttgtctttgtcttcacttttttatttgtatctttatttgcttagagacagagtctttctctgtcacccaggttgagtgctgtggcataatcatggctcactgtagcctcaatgtcctcagttgaagtgatcctcccacctcagcctcctaaatagctgcacccagctaattaaaaaaaaatttttttgtagagatgggggtctcactatgttgatcaggctggtcttgaactcctggactcaagcaatcctcccacctcgacctcccaaagtgctgggattacaggcaagagcaactatgcccagtctttatcttctttaattgcacattcacatggttttcaaagagatttgggtaaaaataatattacatcaggaagaagaaattaaagaaggctatggtacttttaactatgttgaaaataccattttgaagaacagagataatctatgaccccaaaattttgattagaagtataagtgaaatttatcatttatgggtggtattttaataatattatgttgtgattataaatgagtgtggccaaatagtgtctccttttgttcaataaacttttccctaaaacagaggcaatcttttcaagttatattttctgtaaaagtagttttgtcagagccatgctattttagtttgaaatctcctaaaatgatcattacttactaaatggttagactatcttctttcaaaaagctcaataaattaaaaagcaatacctgagtaatctgcatacattttaaggaatattatctgaatagtcttaccaggaagttgggtgatactttttaggtaatcgttttgatttgtttgtgattctagtattaagcgaaatcagtatggctagccagccttttcttcttccaaaattagtttttattaactaattttaaaaattcaaaactctaaagcattaaatactaaggaattcattttttaaatgtctgtcctcttgaaaacaaattatcataatatttttaaatggatgattaccaagtagcactctctctatttaagtgttggtttgctaggtttaaaataaggattcttggtcactgagaaatctgttccagaaagctctatggcagggggatgagagaagtcaaatgtaactgagagttgtgggtgcttatattgttgtatttgcttttaatatttggtggctagaactcctagagttaaacatggactaaagtacaaacctaaatatttcccagatcctcttggggatgttaataaatacggtgttagaaaaagttttgtggcaaattggtttgggatgttttgcacatcactgcctttgcctgagattcaaatatccagtagcgtatcaaaagctttcagaaggctcatagtgttcctacccacgtagcttagcatctcatctgaacactttacttctgtggtcttcctccccaaaacacataactttaaactaatcattacaaaaaacagacagatctcaatagaggggtatatgatttatctgattagtactcatcaaaactttcaaggtcaaggtcttaaaggaacctaaggagacatgaggactaaatataatatagtaccctggatcagatcctgaaacgaaaacgaaagacattaggtaagaactaaagtaatctaaataaactatggactgtagttaaaagtaatgttcactaattatataaatgtaccatactgatgcaaaatatttcaaatagggaaaactgtatgcaaggggtagatgggtaatctctatagtatctgcttaatatttttgtaaatttaaaactttcaaaaatgtaaagcctgttaactcagaaaaagctacatcaacaaggcatgttatttacgtgaaactttttctgtttacaatgttctctgtgtacacaaaataaattgggccatataagaatatggaaatcttaattaagctctttggtaaaacaaacaaacaaaaaagaaataaaagcatgtaaagattaggatactgatgtaggcaagaatctatcagtaaaatgttgtgatccaaaagttcacaattggaatctagataatttcctcaatccttcacatatatgaagatgccacaactcagcggaaacacaatgcttaggctacccaattagatcttttgatatgtgactggaagaaaatggcagaatggagtgtagaacactgcagaatggtttttataaaaagatgtagctaatttttcaatgtacacagggagaggttaattccaaggatgctctcttctcattaggctaccatgtctggtacatttaccatgcctgtcttgggatatccattcatccctacacaatatctggggacggatttgcaagtaactctcattattgtactcaccaagttttcaggctcctattcctatgccaatgttgtatatgtaatgaataatgatataattaacaaacaataacaaatgtaataactactgtttattgagcatgccaggaactgtgttgagccctttattttattctgtttaaacttggtaacaaaccaataaactaagcattgttctcatttaatagatgagaaaactctcctgtgcacacaattcttttcacatagttagtgaggtagcgatactccctgatttactcataagcccttcaatcaatgttttaaaacctaaatttttacatcctgtttaaatatgttcttagggaaaataaatagagctgttttgagaatcagttttgggagagatttggtgctgcagtcaaattggcttaaatgaattaactcatctagctcttcctgctatgaacagaaaatagagagagcggaggatagcaacaaaattcagttaaaaaacccccagacaaatgcttgttagtaatctgatgggaaaacttactttatttatactttctccaaacagagcttggtagtaagaagtgtatttgtcttaatataatttttgcttacttttttggaggcctttgcttgagatacttttttggaaaaaggaagatgttcttagtttccatcaaagacagtgttgcctgtgttgtcatccttactgtggagacgataagccatcaataaggctgcatggtgggcaacagctttccaaaactgagtggtgaatcacctcttttcaattatatatctaaacttggtaatatcagcttgtaagagaaggtcatgcagtatcttccatccaattaacatgtatagaacacctcctccacaactcattcatcctttgctataatttacaacttcctgttgtatgtcaatggttttaactttttcagatcttatttgatttagctgagaaataatgccataagataggatgtaggcctaatgctatatttatttcctttctctctgtaagatttacattaatagaaaatgtcatttcctcttagtctatagatagggtccaggaaagtttatcaaaaaaattaagttaaagctatctttctttctttttttttattatactttaagttttagggtacatgtgcacaacgtgcaggtttgttacatatccagaaaagtgtatctaccttcggctttaattgaacacccttgaaaccaaaacggctaatatgttagttattgtcttttctagatctcactaaaagtcatgatttaagagagtacatgggataatttttcatggtatagaattcctgctgtcattcttcctcccactttttctagcccgttttctcatactgcagattttccctatgctgaaggattccttgactctaccatacagtcaacattcaagaccataattaaatgaaagttcattaagatgtatacctaaatgccaaacactagttttttttcattgttgtttggttttttgttttgttttgttttgtttttgtttgtttacaaaaaggaatatgtgtagaatgacattgatcttattttaaaagaactaatattccagaaatggtctgtaaaactcaagatgaactaattgacccattcttgatattaaacataggttattgtacatgttttctttgaccatagaaagccacacggtttgctacaaatttttcctatcttggtacaaccaatatcagatcagaagatttccccaaagtaatagctactattttttctctttcagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcaggtaactaagggctctactgtcaccaagtgcttgctttgtgctttgaagtcagtttagtctgaaagtgaattaatatacagcactgatcctctttcactagtgctaggactgaaattccagtcagtcagaggaaataaaagaagagaaaaatcatggcaactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttggacctaaatccaatggattgattagaagcatattttttagagcagaaaaaagcaaaatacgtaaatacatactgtaatttttttaatccatcattcaacaaattacagtttagcttttctacatgcaaggtgttgtgttagcttctgtgccagtgcatgtgcaagaaatggtcccagaacttcatgaatcagatgatcttggagcagacatgagacttgtgcatatgtttatttggatacaaagcataacatgtaagtgccacatgagcagtatagaaaggcaaagtttaaagcagattatttctgctttgggccaaagtccccaaattgtgcacaaaatcatcttatcatcttggggtgctgcagcaaattcacaagaatacaacaaggtattttaaatatttaaggggaacagtgataatatctgtcaaacactgcctgaactattagctcaagatagtttacagtttcaacattacattacactatattcctttaatatgtcatatctttgcaaaaataggttttcagcagttgttctgataaaagcaagtaccctgcagaaatccatgtgaaatggaagaagagagtgatagtgtccaacctgattccagggtttgagatactgtgcagtgccccacaggcacatacattcaattagtatgaaattgtggttgagaataaaataaaaatattatttgcacatttcatggttacaatgaggattaattaagatagtaaagtgtacaaagtgaatggctcaagaaataataactgttaattaattttattattattggtggtagtggtggtatcaatatggatgacatagcactcttgatcaagtaatatttttctatagctgagtatacacaactttaacagggtggaacttgggtgtcaggagcactaagaggattttcaagggattgcagcatgaggagatgagagcatgttatagcatattgattgtgaggaagaaaagagttagtatgatatgtcaaggtttttttcatcatcgtatcttgcagcattagaccttcaatattccataaatgtgtgttgagtgagcgagtgaatgaaggaataaatgaataaattcaaaaagaagaaagtcctcttcacattaatgatgaaaacaattgaaaagtcttactttgtcccttgggctctcgccagttgactctcagtgcctgttatgaaagcttgtaatacacaaaaaaaaatcactgcagtgtgcttggtcatgcagtaaaaaccaacaccattcactatttcatctgttcagtggtcttaagtatttgagagcatcagaaaaatctatttgtcaagtcagtgtattatcaccagcttctctgagaaaatgatatacatttaaaagaggctaatagacgtttcttttaaatgatgggtttaggaacatccagagttcattttaaattcagctcaatgtgtatcaaacacatttggtattagcttttggagattgattacaaaggttttgtctgtatgttctgagtgacaaaaattgtaaacagtcagccatgggctaccagagtgatagtcaatccaaactaaactatggtgtgatttttaaattaactttcctctagaaataagcagccaagtattgaatccatgagatatgcatgtgtagaaatctttagaaaaaggaaaatgtaaaataatatcttttcatgtctacagaggatgttccagtgatgagttaatatgcaattaaatttatttccaaactctaatttaacaaataacaacttttatcattcatggtttattgacagctgtttcacaaattgtgtaataaaaatcatctccagcataaacaaatgctcttaaatcccaaatatggtatttagaaatgctatcctttgatgatggagactatagatatgagctggcgtaatattttgatgtgattattttaaaaaggaccagggatctatacatcagctcactcttttatacaatctaccagtgtattacatttttccctataaaggatatttctcaggacactgttagcgtgaggcacttctcagtgacatcaggtccacagctatatgttgtaatatccaggacattactgattaaatcaaagaatcttccctctactttccgtttttgctatagtcccctctttgcattttaaaataatattttctccaagtttgtttctttttaatcatttatataaataagatcacatgataaataaaatgcaatcgtcatcttcttcccccttttctccttcattagagtgggctcacttcaaccaagatccttacttttttccccctcatccactccttcaatgttcatctttattatgggcaataataatttttaaagatgcaaacccatagtcagtgtatccttgatcttatgcactgacaccagagggtgggagagtggagaatattagaaggcaataataatttaaattggctgggtgcagtggctcacacctgtaatcctagcactttgggaggctgaggtgagtagattgcttgagcccaggaattcgagaccagtctgggcaacatggcaaaacctcatctccaaaaaaaaattagccgggtatgatgtcacacacctgtggtcccagctactcaagaggcaaaggtgggaggatcacctgagcccagggaggtcaagactgcagtgagctgtgatcaggccactgcacttctgcctagatgacagagcaagaccctgtctcaaaaaaaaaataataataataatctagattttgtccccttttttatgatttaaaactatccataaaaagaattatttgctcaactgtagcataatttttcattccttaagattttttcttaccactaaagtgtgctttttggaagccatgccacagaagcatgaaaaaaagaaatgagaaactattaagcatctagccacttaggaaagctgtcgttataataagtctaaagcgtaatttttatctttatctttgttttttgtttttaatttttattttcatggattcaggggatacaagtgcagttttgttacatgaatatatctcataggggtgaagtctgggctttgagtgtacccgtcacctgaatagtgaacattgtactcaataggtaatttttcaaccctcacctctttcccaccctcccgcctttttgagtctccaatgtctattatttccatatttatgtccttgtgtattcattgtttaactcacacttgtaagtgagaacgtatggtatttgattttctctttctgagttatttcacttaagataatggtctcccgttccatccatgttgctgcaaaagatatgattttattcttttttatggctgtgtagtattccatcgtatatctacactacattttctttatccagtcatccactgatggatgcttaggttgattccatacctttgctattgtgaatggtgctgcaataaatatatgagtgcaggtgtctttgatataatgatttattttccattgggtagatacccagtagtgagattgctggatcgaatggtagttttattttcagttctttgagaaatctccataccgttttccataaagactgtagtaatttaacattcccgtcaacattgtttaagagttcctttttctctatagcattgttaacatctgttgtcttttgactttttaataatggccattctaactggtataagatgatatctcattgtggttttaatttgcatttccgtgatgattagtgatgttgagcattttttttcatatacctatttggccatttgtgcatcttcttttgagaagtgtctattcatgtccgttgctcactttttaatgaggattttttttttcttgttgagttgtttgaattccttagtccttcgttggatgcacagtttgcagatattttctcccattctgtgggttgtctgtttactcttttggttatttcttttcctgtgcagaagctttttaatctaattaagtcccattagtctatttttgtttttgttgcatttacttttggggtgttagtcattataattctttgcctagggcaatgttcagaaaagtttttcctgggctttttttctaggatttttatagcttgaggtctcacttttaagttaaagcatcattttaaaattgttttccaaagcgtaaataataagagtaatggcttgtaataattctttcctctcttttctgtgttatctttattgaagaaagcaagaggaatgcattttggtccccacagagtttcagctctgaagataactgggagcctcatccttaagtttcagttccagggttggggcccaaactcgtattagaacttgtatcaagatcttataaaagggcaaaagggattatttgtaaaatttgtaaaatattgagtggaaaattattttagaaaatggaaagtgacctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggaaaaaaaaattattattattactattttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtgagccactgcgcccggccgagaggaaaaaattttctaatttctattcatccctcaagaattgcttacaaaactattatggaaatatatataaaactacagcttagaaatgtgtgtagaattgcaagctgccatagtgctcttcagtttataaagcaccgtcatatcttttatctcatttcatctttttgcaatttccatgaggatatctgtcattagtgtcttctttttacaaataagaagactaaggcacagaatggctgagcaacttgcccattattacacagtaagaaagtgagagaggtgaattgtgaacacagtgttcaggaatttcatgcaactctcttctcaactgtcctaacctcaagaagtggtatggatttttttttctatagtttataatttacttggctttataaatatgctactcattgtgaaagctttcaagactcttttagatgagtgtatttttttttcttgctctcaggattaattttgcaaatgtcaggatttgttctttattagaaaatcgtggtgaaattagctacttttctatcacagttgtggatgatgtgattgaaagctggaagggaccagtgagatgacttttcacagtagataatatgactactaccagaatgcaagtctcttgccctacagaccagtgctgtttccactatccccatctgccacattcagaacagcagttagttgcagcagttatcgattacaggcaaagcagacaattcttctattccagaactgccacattcatgtaattttaagtgatatgatatcataactttattcctagttttcaatctgagtagacaaaaaggggaggcaattttgagatgtttattgatactaaaacatttttaaagtatttaaaatcaggctttagtgatttttgactatcttgaagtacagtgctgtgaacactagtaaaaaaaaaaaaatgctgatcacagaccgggcgtggtggctcatgcctggaatcccagcactttgggaggccgaggcgggtggatcacgaggtcaggagattgggaccatcctggctaacactgtgaaaccccgtctctactgaaaatagaaaaaattagccgggcgtggtggcgggcgcgtgtagtcccagctacttaggaggctgaggtaggagaatggtgtgaacccaggaggcggagcttgcagcgagccgagatggcgccactgcactccagcctgggcgacagagcgagactcagtctcaaaaaaaaaatgctggtcacagtagaaagtgcctacgtgacgatcaaaggccagtatcagcaatccccttgggtaaatgtaaagattaaaaggcaattcctcactataatccccacaatttaccaggattcctttgtctccccatcatttccaggcatgctatccagacctacccactgccaaagaggcaggaatggaaaagcttttccaggctttgcgttgtcactttttcagggagctcaccatgggagctatgtcttataaaatctggccctatactatcacatccacataactccagcagccaagtgaccaacactcagttatatacatttattgttgctgcaattttttttttttttttttttttttttgagatggagtctcgctctgtcgcccaggctggagtgcagtggcgcgatctcggcacactgcaagctccgcctcccgggttcacgccattctcccgcctcagcctcccaatagctgggactacaggcgcccgccaccaagcccggctaattttttttgtattttttagtagagacggggtttcaccgtgttagccaggatggtctctatctcctgacctcgtgatccgcctgcctctgcctcccaaagtgctgagattacaggcgtgagccaccgtgcccggcctgctgcaattattattattattattattattattattattattattattattattttgagaccgagtctcgctctgtcgcccaggctggagtgcagtggcgcgatctcggctcactgcaagctccgcctcccggattcacacccattctcctgcctcagcctcccgagtaactgggactacaggtgcccgccaccacgcccggctaattttttgtatttttttttttttttagtagagacagggtttcactgtgttatccaggatggtcttcatatcctgacctcgtgatccgcccgcctcggcatcccaaagtgctgggattacaggcgtgagccaccacacccggcctgttgctgcaattattaagtttgaaaacacatgaaggaaaagtttggcagctctcacatgcaaaaagctgcatatgcctttaaataaagcttttctctctgttctgcttttcaatctcagaagattcaaatctatcttttctcacctcgccctttctcccctgcctccgtttctagatttgcgatttactaataggagtcagcatcccatttaaaatatggcctattctatgtaatatattaatttatgcggagcaaaatagcactgagccatttctcctgcaaaatgactaaagccatccacaccaaccccccaagcaaataaacaagctcgcctaacaatgcgagaggttgcagattttcctttcctagttgccatgccaaccactcattgctctggctgccatttccctgagctccgcagagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgaggtttgtattgtcacgtttgctttgtcctatgtggtctctctactaggtgaagctggttgtggggattagcttcaatcataatatttggcttggcttgttgatgaataggatttgaacctaatttagggctagcttatatggatattataataaagaattgtgtcttttattcttgatacaatatgaggttgtatatagcaggtattgccagccacagcgtttgatattttacaaattagaggaaaaaaaccaacatcagataaagttttgtttcattgtacagctataaggtagtttgtcccataaaaatctgtctttgctctgtagtccagtcttaaggtaggatgagattttcttaagacggtaattcttaatcgatatatgaggaaaacttggtttctcaagacttgtttccattaaaccctatgactcaacaaattaaggtatgattttattccttggaattttaattgcctacaaacacttcaagttgtgaagagcaaggctctatctaacacaatataataggatatttaaaaactgaggttaattgcattcacatgtacttctatgtgtgttcctcaagaaaattcctcccatgcactgtggaaatcagtctcgtttcttgtctcgctttgtgctaaatgtcagaactacatcacaagcgcaaaaagtatttcctcagacgttttggtccactgacattttaaaaattattttgttgaatttgaatcttaacgaaacagatttttgccaatgacaattcagacctatttatgaaaattattctttctagtttgtttttaagtgcaaatataatttaattatcattgtaatttttacttgacctttctctcatcccattttttccaagatcttgttaagttttctctcctctaatatgctgtcatgttttgtcatcatatttttcttttaatgtttttcaatttttttgagatttaaaaaacctccatttagataaaaatttaaaacaattcttaaattctttttttatttttagcaaacagatgaaagtaataagtaatgggagtgagtcttctagactcatttttggactgtctaagcctttgttttggttaggattatgcatggcctttatctgtcctttgttatatttcggagtattttctcctcacaaaagagaaaaagaaaaaaaagataagataaaaaatctaatacttttgaacaaataaattgctcaaatatcttgagactatatttcttatcaagcaataatgtgtttttaagtgtgagatatatatatatatacacacatatatatattctttgattatattacttgtgtaggtctgagaaaaatgtttgccactgtatgccaaatgctgccttgcggtttagaattgggtttgattttattgcggttgggaggttattaagtagactggagagtacccagcagttatcactcctcttttttcccctctaagctattgagataaactgactctttctacttcagtgtgtcaagcctttttctcttcctctcattccctcacacttcactgctccccagtacattacataaagcacgtgctttgactgtcaggggagtctggaaatcatatcaggagaggatgaacagaacaactggtgctgcattgcagacctggtagcttcagcattatctgacctggcatcgtgagtcctgggggaaaaggacactaaaccgtgtcctgccggctcactgtgtagctcgtctcactgaatgagtcaccattcagcaacactcatagaaaatacagttcaaaaaccagccaagctgatgagcagaggaaggggaaaacatatgtcataggttgtcatgcaacttttaacaatgcttttaacaatttttgcaaatgctgggtggttattagaacacagaaatgagagtaaaatacagttgatttcaggaatacgcaagaaggcattaggcaaaaatagataagaaaggaggaatcaagattcagagaaaaatcatcctaaatacatatgattcagtttaagcatcctgaaaatccatatttttaatttgtaaacacaggtcaaagtgatgctggcatatgagcacctctggttcttgcaaagcatctccagcatgaatgatcagtcctccgattggtctaaaatgttctcttttgtgacacgttgcatttgccgaatgtaaatgggcaagtttacattgtggtgttttcattcccatgcagtattgtgcaagaagtcataagaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatagcaatcattttactgaggttacttgttatttgtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcagatcacttgaggtcaggagttcaagaccagcctggccaacatagtgaaaccctgtctctactaaaaatacaaaaattagctgggcatggtggcacatgcctgtaataccagctacctgggaggctgaagcccaagaattgcttaaatccaggaggtggaggttacagtgagtcagatcacgccactgcactccagcctgggcaacagagtgagaccctgtctcaaacaaaaaaacaaaaagaagagagagtatccatatatagttctgagaatggaaatcacataaacaaaatggtctacaaaatttatactacattgtgaacaataaatttgcaggaaagactgtattagaaaggaaaaccgtggctcatgcctctatcccagcactttggaaggccaaggcaggcaggcagatcacgaggtcaggagatcgggactatcctggccaacattgtgaaatcccatctctactaaaaatacaaaaattagctaggcttggtggtgcatgcctgtagtcccagttactcaggaggctgaggcaggagaatcgcttgaacccaggaggcggaggttgcatgcagtgagctgagatcgcgcccctgccctccagcctggtgacagagcgaaactccgtctcaaaaaaaaaaaaaaaaaaaaaaaaagaagaagaagaaaagaaaggaaaactgagaatgaagaggtaatcaagaaactgaaaacagtctagattcaaagtaaggactttaaaagtgtcggttagaacagaaagaaattaggtaggaactccaaaatactgtagtgaaagtatatggtggaagacttgacttgttctgaaattgggagtgagagttgggagtaaagaaaatatatctttgactgaagatagcagtaagatatcaaattggagatattttcttgatgatgaaaattactgagctgaaaataatatgaaaagtccagataaatgaactttctaaaagataatctagtggttaagaaatacatagatacagaaaaatttttcatgttcatttctgcagaattgaggccagtgtaataattggcttaggttgaaaatgccactgaaatattctgtaaatggaactctataatgcatgtcttttttgatcctctgactataaataaggattgctgcactgttctaggtcaagtaaatctcatttctgacaaatgggcaatctaaatcttaaagcatttggatattctaagtcatggatttaatatgtgcctcctttaaaggagtataccagtatcgtcttggaaagatattatgtatcctatttttgaagaccaaatgtcaccaatgccctttattttctctatttcatctttgagtgcataaaattatttgcaaatgagttcttagatagtaaacaacattatcatatcaaattaggaatttatacattaactttaggaaaatattgtgatttcagttaaatataattccttagtttcattttagttttcatttttcacttaataaaaagcttcctgtgatccataattttcttttcctttgacatatttgaatgaaaatgctcccatttacattttctaaatctaatcattaagtatttcagtgtttagtgaaattcttctccaaggaggaaactaatagtagtaataataattattgacttacttttataaccacttttaaaaaatcaattcactggatactttttctccttgttgaattttgcatcttcagctcatgtttatttatgtctttctttaaaaattggctttggttgtttttctcatcagcttgaaaaatagaatttgtgactaaagcattaaaaaaattggaataaacttgctttccttcgagctttactggaacacaaatgctgacctggggaaagtggctttttctccaaatattgcactaacttggtgtagatcacaacgcatgtaagatatttattttctccaggccagttctcatctaattctttataaatcctgattgctataagaaaagaagcaaatgattgagtttgatgcaaatatagtagccacttaacaaaagtcacattttaagagaggaagttcattcagttgggataacagtagaggataacagtagaggaataacagtagaggaataacaagaggataacgagaaaggaagttcattcagttggaataacagtagttcccttctctcatctgccatcctgaagaaaaatgtgttatgaaatgctctgcagaccacatttatcttgctcatatgatcctaatacaacatcaaaaatactgctcaaggaattggctattttggtgacacaggtttcctttctagttggatttcactctttaagggtgaacttaaattactctagctgactatcatcttatgatggaattactagatacgtttgaatttaatttttttatgtgaagaaaaaaattttatcatcttatgatggaattactagataagtttgaatttaattttttttgatgtgaagaaaaaaactcccccaaattatacttatttttaaagtaaattttataatatcgagcattttttcaattctaactagaaatgcttgaatctcctgaggcttgaataatggcaagtttcaacttttgcctgtgttctttgatacaactgaatgtggaaaaactacagtatgtaaatagaaagtggttttcttcaccagttctgtgggaaaatgaaaatacgatatttgctttttaaagagtattttggacactctaaactctatttaaaatgttgaggtatttcttgtattttatgctataaaatttcagtaagacactttaattaacataatgattgtattaaaaccatacttctcttcctatagcttttgatcaccttctagttgttttcagatcatgtcattcctgcctctttgtttcatgtgtgcatttcagaactgtccaagaaaaagagcaaaaacaacaaagttctctggtttcatgagagtttttacttttacagttttttttaaagaaaacaaacccaaactacaaactcacataaaatatttttggaaggggtggtctctgtaaaagttgggagaaaagtgactgataaactagcaaagggaaaggaaaggaatctgagaaaccaagctatttttaggcatattcttagaaccgagaattggtcaactgcttcatgatcagggctcctgtacatgaaatactgacattgtaatttcattttgaaaaacaaaggtacaagtcctgatttagaaattttccttatatgttgggaagaaaataatatatttttcatatattatcatagtaaattgaattttcattgtaatattttcctgaaaatttcagggccttttaatgaaatctgattttccatatcctcaacaagccccaaatgtctattccataagattgtgattctcattccaaatgaagctctgtctttgtagaccaagtatgttgtatgggtatagtaatatctgcctacctaggaccggccctatgcagaattagaaagtaaatgaaacatgacttcagcacttttctatctgcttccccaatcccttctcttcattttcttcaagtcagcagtcatatgctcatatgcctaaaatcccgcataaatcccattacaaagcttaatctccttgccctatatcaggctacctacctagatagcatcctgttcttacatttttctcaactctaccactccatcaaattttatctacctttctctttctgctgggctcctacaataggacaaccagagctatttcaataacaagttacagttttatgcttctagatatcatttctattctgatataaaacttcattgtcttcaagtaaagagtgagttctttggcaagtataggtataatagagatggaattcatgctttgaaggtatttctagaggtgtgcttggtatcaatgagaagcaatacagtggagagatgcagctatagaaattgacatgaataaacaacattgaagcaaaatcatcaatgtaaaattttatttcaacaaacgccccagagatattttctaaagatttgtatgctatttgcaaatttctcaaggtgcatttgaaattattatttgttttttatttgtcttacataatgaagaaataaaattgaaaaatgtatttaataatattttccatggggtgcatttatcaatacagagtctaaaagaaatcgtctttattctagaatatttttgacatgaagaaattttaaaattctattaaagtctttgctttttactgtcataatggcatcgaaatacaaatatgacattgaccttacccttcttgctgtaaaaagaagatttgcaaagtctgttgattttgctacgtacaggtctggcaaaaagtattttaactatcatcaattttacatatttagaatttttccagtgaaggtgctccccttctcttgggttgtggctgagcttttattttacagcattattaaagaaagaatagtaggatggttcaaatttactttactttcttttgctttttcttaagtaggtatttcagttttcagaagttcatagtgtaattgatttcactgtacttccccccataagattactgaaacatgattatctgattatatattcagttatgatttgaaaattacaaagaactaccatgtctatttaacattgacttttaaagtctgtcaagtcatttcaggtgctggtgtaaagagaatctttgcggacaatacttttgtagctataatgatataaaatatgcaggtatagaaaatgaacagtcacttatttacaacattaatagttaatgagaaacttgctaagaagaaagcagataaggttgatgattgctgctatttgcgaattcttagaaacgttataggacgggaaggaggtttaagtgaaatctgattacgcagaagtcatgttggtttttccatgtgaacattgagtgtaccttctgatgtattttgaacaaagtgatttttcccatcacatggttcctaaattccatatgcatctaggtcacaaggcttccaaagatttctaagttatgttggggatgagagagaaggatcaaacaaaagttagctaagctgctgatctttaccattttattgtaacaaatatagtttctcctagaagaaagatctgtgtttacagaggtaactagtaaagactattcttggtatatagagaacttaatttcaaaagtttattccaatgacatccttttagaatgtagaatttttttccatcatatcctgtctcaggccagcattggcattcctatgttttgcagctatagaagcattgatttctccataagaaaccctagccttgctccttgtgcctaagacctgtgaggtatccatgtacagatgagactttaaaagcatggacagacctctatgtgcatgagtcctaacatgtgcatacacacacacacacgcacacacacacacacaaaattgcttttccacaaacccactatattttatattttgtttatctcacagttactctttctaggggtggatttattcaaggtctctttgttttattgatattttattttcccactaatatttaaaatgtatcatgctacattcctttagcaatgtgatgtattttaagacttaatgaagagaatataatccaatttccccacatctacaaagagtagtacaattgtaacagttttgacgagatgcaaaacagaacatttcaaagttccaaaagtactgtcaattccctcagtgccttaatgattggattcaatttattggtgttaaaactattgaaaatttcaggggagcaaacctctctaggaatttctctttctcaagttaagattgataaaatattacaaccttagttaattagtaaatatgtaatataggggctacaaacaacataaacatgcaatacattactccattggacacccccaaaaccaccaccagcagaacactttaactagaacatgataaatataaagctaaattgtaacgatactggcttaccatatttcttctgcttaaatgtgttttctgtttcctactttcagctgggaacttaaaattagaagcaaaattttccagtaggtactatctctgatctgtgcttttctaattacctttgactccataatgtagtgtttttaacctgtggtgtcctttcactgataatagtattaatttactacattttcctccttgaccaaatttaaatgctaggccagttctattaaactctaaagacttcatttgagtacattaaggtataatctaaacaagattgtgggtttgagcatgtacgtggaggtagaggaaaaaaaagagcaagagagggagaattctcctatgattatacactgtactcacaatcctagtctaccaatttgtaaatccgtttcagaagaggaccatatgagtgactgtggcgggatcagtcaaaatttgtggccactactagtaaatcttgaagaagaaaaataaaacatgtccttgaacaagagtgcccccctttaaacacaacttaaatgtaggaataccatatcttactcatctttctatcccccactagtgactaagaatagctccattgtctatagcaggtgcaaaataaattctcttaaatttaagtacccatcagagctgaattttgtgccatcataattcttttatcttaaatgcatttgtcttcgttaactaacttcgcctcaaatgcatttttccccataaaccaaattgatccttgttttaatcgctaaatctttagaagaaatatctggaaaaaaaaagctggtggggaaagatctgtagctgcaatgttggccagtgtgacccctgagattaacagaggtctgtctagggtgagacatgccaatgctggcctctaaataatgcaaaggtgccagggaaacaaacaaataaaaacccaacaatttgctcttttaatttccttcatcatcagttgattacaggaaatagtttcagaggaaccatttactctccaaattgagcaaggagtagaagcaaataacttttcttctttccctatttttatgaattcatctagggtctttgtttagcagagtgcttcaaactacacagtgctttccttgttgattagtttccatcagcagcagcaattagcatcggtttcctaggaaaccattctgtaccctactgagaaaaaccttttcttgacaggagcattctgtctaaaattgttttgttttccttcttccacaagcgtacggtaagcttatttgtcgttttctttgaacacaacattattataccaaagattcttaaaacatttacaggcttttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgttacatatcactcagaatcactcagaaacaagttgaaacttccaggatcattgaaaaagtttcatctccattggttatttttaatcaaccaagcaatattgatagataaatgtaacacaataactttaaaatgcgctaaaagcaaagcctgaggttgtcttaaaatttttgttgtgacaagtagtgtgatcagaagagcatggcaatggtgcagcatgaatcagcattagggaaaaaaccagagggtcatgatggctacaaatgctgagtagtatgatatgacagtagggcaaaatttaccttatgttccttttagtttaaataataagtggcaggagcctgatgtattgtctgttagggtcccagcagtgacccaacatttcagcaaggaggtactcattgggaaaaatgacagaataatctcagtgtctgacaaaaactttcagatcttacctacattttgtcaatcaaattatgttcatagatttcatgataagagaacatcaagagtgattaaaacagtggtacctaatttaaataagcacttgatttatattattttatttaattgtcacaacacaccaaaagatgaatactactcttattcccactttacagatgtggaatctgaaggttagagagattgttacttaacaaggtcttttggctagtaagagatggagatggaatttgatcccaggttttctgacactagaacctacttttatataaaatactgatgtaaatcataacaatgtctaaatgggacaagcatatctttatccattattttgctagttttcccatctggactatctgtaaatatgtgtattaaataacatcaacaagaaatgaaagtgcctactgtaacaacttgttatacaaggttgcttaataacgttgtataacagtgtgatgtttattcattagttaggtgagatgtaagtagcctagcatgataccgtttgggtttcttcaagtagtttttggtggatgacagcatttctcaattagtttctcatacatattaatctcctgtatgtgtttccaccaatatatttccttaataccaagaaaagatattatttgtttccagaggactgctttgattctcttttctaaatactgaccccatctttgtttcccaggaaaagttttcaagacagatttcactttttatcttcagatgtttacctggatagtggtgatctgctatcatctattgctctgttgcctagattaaatatttaaatcctttattcttatcagcctttaaccaataacatttttagaaattatgagatgaattttatttagaaaggttcctttttaatgttttccctctaattgatttgtgagcagatccaagttgtcactcatgcatagccatgacgtgactttacaggcatgttataatattttttattacttacagaaattgtctcattatcatattgacactaccgataaaataataacaaattaacattcaaataccaatgtaagggtcttactgcaatgcaaaaactacggttaattacatcaaaaccctgacattcattcacaaaagacagaatggaacattcacaagagaaagaatagaaaaacatattgtatacacttattaactaagataatttctaacataaactaaaaaatgtccagtgccagaacattttataagttcaaaagaaagataattgagcctttcaaaatatcagattacaataagcagttttatgtttgtttaatattttcagctatgaagatcagtgttacctttcaattacatataatgaataataattccccaatttatgtgtaatctagattcatctttaatcttctaacaactaagtcctggttgttataactttacacctatgtttggaagaaaaagcaagaaaaagagaatagaaagtataaaaaggaatagaaggtaggaaaagtaagcaatgaaaaattaaaatgtagtctaatctctgacttcaaaaagaatttttcatgtcaccaattgtcttcagaattagacaggattatcataccttttagagccctgtctagaatagacagtcctgaattgggacttgctggatggaatcttgagcagatggtagcccaggacctatgcatccaggaaactgggtgtgaagccagaaaataaataacaaagacaatatttacttctctcatatctttgccttggaaaaaaaaatacttcccttgtccattaacatagccatcaacatcagtgatattggattaactatattttcagatggttataataacaatagcctagttgggctgacctttagtgcatatcactattgctctttctttaaagtagaaatattaaagtagaagactcagaaaaatacatgactaggggaaaataaagatgtgctggtgaaggactatatagaagtttttattttatttgtattccaggcctgttatataattatttgccaggcctgttatataattatgtaattgagtccccacaacaacctctgagacagatactaaaattatttccattttatggataaggcatcgaagcaaaatgagactgaatacatttcatagtatgaaataactagaaagtagcaatgctggaatttgtacccacattttcctgaattaaagtctgtgagattccctctgatgtgtgctgtaaaaaaacagcaatcagtaatcccctaaatatatagatagatggatggatggatggatggatggatggatggatggatgaggtatttaatagacaaatgtagaatcagtgaagaaattacatatataatcacacacatcataatcattacatttatatttttataggtctgattttttgactgtctttccttgtcttctaagtttgtttggaacatttaccattaatctgccctgaactttacacacactctgactgaatttgctcctgtcccagaagccatgctataaggatgaagctcacccagtagatctgctgatgaggcttccaatgagagaagcccatctcttccttccttaagaatgcttctgtctctgctgatgacagcccttacttagaggaagattttaaattaattggaccagttgaaattcccagaacaatcttaggctcctgtttccctaaattcactgtgaactctatattataaaatgtgacatgccctatttgaaaaagtttaacaatattattctctaaaaagtcttaaagataatatgtcaattaagccaataactttgactatgctaaaataatgtttctcaaatcctcttaaattacttcaaagaagaaaaaatttaccaattctcccttggattattttttttaacaacttttggttaaacatatacaaaaataaaattaacttgttcatgagttctaattccattatgggacataaacacacttataaattcattttctctgaaacaacaaaaccagtaaaattcaaactctctgctgcttcccatctacaataaatgatactgctttgctgaaactaaattatcactcacgattagtactggctgatacagtgcctttgtttaagttggacatttctatactgaactggagacaggtaatacttctattctccttttttctctgtttcaatgattttcaaagtctatttatacagtgtaccacaatgttatttgggctacacttgtatgaatacatcctttatgtattaaatccacctctccttttttattagctctcaacacttaaataattctccatggatatcaaaactgtatcctaagatacaatcccaaagaaaaatactgaaataatgtagagttgctcagttataatttgctcatataaccaatggatacttatttattttggattatcttcccaatctaaaaaaagaatacatataaaacactctcagaccctaaaaatatttatcagtaattaaacaagaatgcaggacccccatttaagaaatactgttttgatatatatatcaaatacttaataatagagtaaataagataattttaggttttaaggttactaaatgtagtaacaagcatgaattatttctgaatgtttgtaaatattatgaacaaaacctttcatattaattttctattctgtcaaaaaaaattctgttaagcatccaatctgagtaaagctcaataagagaagcttcaagagttgtgcattgcaacactattcacaatagcaaagacatagaatcaacctaaatgcccatcaatgatagattggataaagaaaatgtggtacatatacactgtggaatactatgcagccataataaagaacaagatcatgtattttgccagggcatggatggaaccattattcttagcaactaacacaggaacagaaaaccaaatattgcatgttctcaattataagtgggagctaaatgatgagaacacatggacacatcaacatcaaggggaacaacacacactggggcctattggaaggtggaggattggaagagggagaggatcaggaaaaataactaatgggcactaggcttaatacctgggtgataaaataatctgtacaacaagcccccatgacacaagtttatctctgtaacaaagctgcacatgtacccctgaacttaaaagttagaattgtgacaatgacagaagagagtccctgacttgggaaaccttatatagtgtgggagataagccatgtgaaccagcacaattccatgtgagatgtactaaatgccataggaagacactacagtttgcatacgtgctaatagaaagatgcaggaatgatccagaagacacaaaggtcatatatatatatatatatatatatatatatatatatatatatatatatatatctcccaatttctgccatgattgttccacctctttattacactcaatttttccataaatcactggggtgctagaagaagctacctcactctactgatttttaaatattttaattgcattaaaaattaatatatgtaagcggcaattctcaaaacctaaaataattctttttgtaacattattaaacaatttagacgtctaagcatgatctttacagctaatttaattttctgtagccctttttgtatactctttcccatttaaaaaaacatcactttaggagcccagcctttcagagaatgttcagagaaaccccacccagcagcctggctttatgaaaacaaacagcctttccttctctactgccctcttcactgagtagcatagcagataatcctcctcataatgctttggtgactgttaatgttatttatttaactgctgtaactgtgaaaaattctattccaacactaaaacaaatatgctaataagatagtattatctcttagaaataaaatagtcatcttctaaaggtaaactatcacaatatctaacatggtctatgagatatataggtaggtaggcaggcagataggtaggtagatagatgatagattagatagatagatagatagacagacagacagacagacagacagacagacagacagatagatgttgctcaattgtggctcatcacttgttgcatagcttccagctataatcaggaatggaattacaatgatgtattttagatagacatatagctgagcaggtctgatagtgagtatgtttccttcattcataccactaaaagagttgatatatttctgttagtcattcactcacgactgttagaaagttttgtgattatgtgtttgttatttcttccattgttctgcttaggagaaagaatattataatagtcaggaatgctaaaaactagttatttggtatctcacagaccaatcattttaattttgagccctccttttaaaaaaaatgaaactaagatgatttgatgtcatatggctttaaagatctttaaaatatcaactctctagaaaaatactagttctttagaaagagaccatctgacatatcattgccatgtatttcattaaaacttcatctttccagattccttataatttatcttattttcactgatcctggataatgctatttaaccataaatagattttcagattttaaataatggtatttctgcaaatcaagcacacaagcttatataaattatatttttagaatagtataaggaaactataaaacaaatttaagttaaattcaaaatgaaccctctcttctatccttgaatttgttttactaggtataaagaaattaaattgtttctatttttgtaaacagcttttacaaaataaagtaccaattaccttcacattggaggttaggagttcaacatatgactttgggggcaggggatacaaacactcattctataacagagatgtcatagacttcagagttgaaaataaatttctgttgttgaagccaaaaaaatgttcaaatactatgtaagtattttttctcagttctgtgctcattttgcttgcttagcttagctcctagaataccaacttcttttcttcttcttttttgtatatatgtgtttatgttttctctgcaattaaaaaattatgttgtactttttagggggaagaaaatgaaattataatccactatactgtttggttacttttcctctttgctttctcagacttctcatcgttatattttattttgttactgtttattacagaggaggtgtctgcaaggatagttcaagtagtcactgctgaggctgtagcagtcctgaaaggtgaacaagagaaagaagctcaacataaagaccagactgcagctctgcctttaggtaaataagaagattctcaggtcagggactgtgtctgttgcaccctgatcacaggataaagtcttcatgttcaaaagataggccatatcttgtacttcatccttacatgtaacattcatcagacaccttgactgggtatgcactaggacctattttcatctttttccactggtttgttgtagtgtttgcatagtctttcgttagggtggtgagcttacagttagacttttccctaagtggcccttaattttttcattttccagaccactagaaatagttattattaaaataaagccaatgccttatttcatgacctccacccataaggataatatactaaaactttcataagagatgattatttccctttacaggttttggtgaatgattatactgtagccttgtttgggtcttcctgaaatgactacacaaaacctatagccagagctttgttataatcgtgagtgactttgtatcttatatgaagtactgaacttcacttggttcatctaagggcgctgagagagtgctgctctctcccttagtaacaagacaaatgccctccatgccaagcaagtcatttaacgcatgcttgccaaaggaaacactctcagccaaagccttgctgcccctactcatagatagatagatagatagatagatagatagatagatagataggcagatagatagatagagagatggatgtatataggcagatagatagatagagagatggatgtatatacacaaagagatacaggaaaggagactctcttaaattcaatatatatatttatttcacaggtatatacacgtgagtcatagaaaggtgtgtttttaaaggcctaaaaaagtacatatccatttccctctcttacagtctaatatatccatgatatttgattttttgatcagtattcctttaactgtctattaaaaagtaagtaataaaaataatctgccctcccagaataataatttagaatacactcagtattttcagtactgtgggtttttttaattattaaggactatttttctcttaaaacacatagagaattatctaatctaaaacattaaccttcagtttattgttcacttttattccttgaaagaaaagaaaactcaattttttaaaacttgaaatcttaaaatacgccatgcagaagcccatagggtaaggaactaaaaaagtcacctgtcatcccaaatctgcctctaataactactttatgaagctgaaattcccctaatatttaaaatagatttaaccactggccttaaatgagaaatatttccttttgaaatttcttactgtcatatgagggggatcacaaatcatgtaagtgtcttgaaaaataaaacttaacattaactgtaaatgaattacatcttttagaacctttttctctggttccttttcatgtgtattgattgctaagaccagaagtttactcagcatatggtttttgtctgaaagttcactcaggctatgaaagcttatttttccatttctgagaatacatacagaagatgggttttgaaattagactcagtgaacaaaaggttgtttaaaaaatatattccctaaaataactattagtgatcaagataacacatgtttccagattgagcagttgaacaatagagagttctaatagttttttcagtcagtagctgaatccagactaaaaacacctgcctgcctgtgtgtgttttcatatggtaaattagggccaaaatgaaatattttattaattgaacaggtagacacattaatgagattaatgatggaattttagcaggcatctctaatctgtttttctagagatgataaaatcatttttttttgaaaatatcaaatgcttgtcttattttttaggttttcaaaaatgcatgaatcaggtaatgggcctataaataaaccaaatgcggcttactattgaatctttttctgaattttatagagaggtctttttacaaatggcagaacttcctacacatctaccagcctaaaaggattaattattgcatctcatttttctattgtttgatctttagcagctgaagaaacagctaatctgcctccttctccacccccatcacctgcctcagaacagactgtcacagtggaggaaggtaaggcctattggacttttcagggtttgtcttctgttaaagtgtgaacaataaacttcaatcaataagctctggactttggtattggttagtatgtgaccaagctttggagctatctgtttcaaataatgaagaagaaacaaagactttaaataaataatcacttatttttataaaagcaaaagtagaggaatttggtaaataaaaaagaaatctgcttgattaaggaaaagaattttgtgttcagttgctaaaataactgtagagaccccattcactttagaatgctttaacagggaagatacaattctaccttgtaagtgactgaacaaaaattaaaataaatataaatgtaatctccataatagtaggggtcagatttatcaatgaaatcaacacttccttatgaaagtgtcaggaattatctctgttttgctcactgttatattgccaagaccttccccagggcctgactcatagcaaatttaataaatattaatgaataaatgaagaagttaatgaatgaatctgatattgagagcattgaactggaagctgagctcatgactctttcctgttgagacctgttattgtccatggatctttttatgaacttactcaacatggaatgtcatgttagcttttcaattctcattgatacaacagaaagatgcctttgaagaattttcattcagaatctgagatgaaaggcactacttaaaaggaaaccattactggttctccgacttagtccagttaacctttgtttattgtttgagagtcacaggaaaaggcagagaagaactagggctccattgttgtttcaacattacttagttttcatatattaaaaccagaattttaaaagtgtttattttattcatttattcatttatttttcctttttactgtgttaaagactgaagaacatttattttaaaagacttgtctttttatcatttgtaattaggttcatttaaaatattctttgatttcgtaaatacaaaaatttgaattagtgaaccatatattatcacctctaatataattttattttgtcacagatttataaacctaaatttattttagcaaggtttttctttcttaaattgaagctttttttttccaatttactgcctgaaataataaacaaactaaatttttctgaggaataaaagaaactttggggataataatcagtgcatagcagccactgattattagttaatgtgatttaatcttttaatttataggtttgaaaagttccttttgaccttatgtttatccattcactgggcacatatttattgagccctacagtcttccaggtactcttcaaattctgagtatatactagtgaacaaaacagacatgatccctgcttttaaagagtacactatagccggtaatcccagcactttgggaggccgaggcgggcagatcacttgaggtcaggagttcaagatcagcctggccaacatggtgaaaacccgtctctactaaaaatacaaaaattagccaggcatggtggcgtacgcctataatcccagctactcgggaggctgaggcaggagaatcacttgaacccagaaggcggaggttgcagcgagccaagatggcaccattacactgtagcctggtgacatagcgagactccatctcaaaataaataaataaatagtacactatctagtggagaacagaaatccaataaataagcttaccaataatttcaaattggattagcattgaagaggaaaagaatagggagctttaaaatattacaagagaaacctgattttattgggtggtgaggggatggctaagtagctgagaccagaagcatgaggaggaagtgttggccaaataaagatagaaaaaagcacaagggcgctcaggtgcccaagaagatgaagtgacccaggaactgaagggggtccgtggctgatgggtagtgagaaagggtagagcagtggagtgtgagagtaagcagtggtcagctggggtcagtggcctagatttcattctgaatgcagcgggaagcctgacatgacccttgtacctccttcaggccatggaaaatgtttctaagctcctacttaaagcttttcaagcatcagagaatcctcttaacccagagagggatatgatgttgacagagcaggtttactccaaaagtcggcttgaggtcaagtcatttaatcttcttactctatatgggatttggaacagaaagggaagaagcagagtcctcccatccatctgggaattcacccagcctgcttcctgtagggtaatatgatggatataatgaaaacataaataaataaaatgtagaatcaccttcacattttggtaacttaggtgtcaactttccagagttccctaatattttggaattactttcttcaagctgtttcaagatattcaaggaaaataccacctaacctcttattgaaagtaattcaaagttattttcaagccaaacttgtgtttttaactttttgagtattgaactatctgaagttctgattatttgattttaaaagtataaccattttttgagttttaagaaaaacagatgtatatattttataaactctatctctataaagaccagataatattctcaccttaaatatgtaaaagatttgtggtctagacaaactactgtttctcttttatgttaagccacacttaagtaatatacaagtattttttaagtttagttttgtcagaaaataaattagtgacaagtcacaagacaggattgaactgttcaatttttcaaaccaagtagtttgtaaatactcagcccaaattccatcaatatattgcttatagcaggtcaggtggaaagggagcaggtggatttttttgccttatctaggggattatttaccctccttgataccctcaaagcaactttaatctgagggtatagtgactgctgcagtctgatccttttatacaaatggaagaaagctcttttgttagattaattcagcgattttgaggatacattttctttttgttaattatcaaactttttaaagctgttctttcccaaaggggaagcatgaaagcttccactaaaaatttaagatgttaattactataatttatgaatatttattataattaatgtaatattagtaattcccaggatatgtgcttattctagaaaacatttacaagggattttgatgaaaaaaaaggaaacaagctgcacacttagaaaaggatctacggtacagtaaaccaaacctgtactgattatgatgttttcaaattaacctcctttttctttttggcctaatcataatagttgtcatttggactgagctattagaatttggaaggctgtgaaggaatggaataatctgaacacagaaccaggattctttctgcccttttaggtttgctccagaattctagggtggtgttttcctgtgtcatggatgtggtgacctaatcatcgcgcatctgaaagtagttttctctttatgtcattctggggcagcagtaacagtcagcagactgagaagtcctcagtcaaaagctggcagaatggaaagggcttggaaatggtggagaacaatgtaagtgcggccagcagccatcgaccatatgctgtgatgccacaacaagcaaaaagtaccgaatcactaacattccacaagatgcagtctccaaaggaggctggtatactaaggctgggttttacatggcaaaccttacattagcccagtgtaaattttcaaatgctttatttaaaagaaaaagtttcaatgaaagcaaactagggaaactttattcctccattgaaaccaggtaagctttatttttgaagattataattatgcagaaaactatgcaaaagtccaaggtgtataaggttaccctgtttttagcataacacgtgattaaatgaaatagaatattctgtggcaaaagcagagtccccagaagcatgcccacttctagtaaaaggatgcatgcattcaatcctgacctcaaacagcaaactaactgttgtgaaataaatttaatttttaatatatctctcaactccaactttgatgtgctaaatgaggggaaagaacagaggtacctgacaacttgtctgagtacactgaagacacagatgctaagatgtatggagtcagacattgtgcttggcattttcacagatatcttctcatttaatcctcccagcaacccacagagatagataatattcatttccactcctttgcccaaaatgttatggtttatgtctggagaagtggcttatccagaatgcaaatccaaatctaaattctgcaatcacggttgcactacatccctaaagctgtttcttatcaaggttcttactgtgagactatggaagtaaattatcttcaaatgagagttatttgttacaagctactatactaatttcctttaagaaaaaaaatcttacaaataaatattccatttattatttatttatttaaaattattatgtcttccatctgcattgggagtgatccagatgcacctgccatacacaacacaataagaaatgagaatctaatgtcttctgtcattatcattaaaatcaagtgccctgtttggcttagccctccctggtccccataaagcatagcttccctggcatatctctagagcttgtaacgtagatggactttaggctgataggtcttaaacagagacttggagtacagacagcttacagtaccaagagaagattggactttgccagacactctttttgaagttgccttggtcccaggccagatgaatactaaaaagaagctactttttccactagatctttcaaaatttgtgttgttctttttgttgtttcctgattagagtgaaagttttcagaatagaaaataccatttaccatttttttaaatgctatagatctgaagcaaggctctggactgtttttaaatgttggcactttcacaaagaacaatgacaacaagaaagaggtggccagaatctgcaaaaggttaaaacatccaatgagtattgcctttactctcagcttgaaattctttaattttatactatagtctgctgtacctcccagaaaataaatgttgaaaagcagagaggagcatatcccattttcatttattgatcatgaaagtaccctactgaacatatcaggaattttagaagtaacttgcatacatggggaatttacagccccagagatccactgagagaaatatgaatggctaggacatgtgacaagccagggctatgattcagtcagtgttgtaggccagatcttggacaattatctgctcagctgcgaaatcgtgccgagttgaactaagaatatcaaacgttattttaggcttctgctatcccatgatataaaaagcattgtggctgagaaagttctgagcatccatccagaaacatcttccatggaacaatcagtaaataatgtgcttgaaagattaaatgtattctctctacaaaatgttattttagtatcctcatgatttcagacttatttctagttgtcagcacttggttgccaaaaataagttactgtcctaaaaatacagtatatttgcaaattaatgctataattttgtcttcttaaaatctgatataaataaaaactgtacagatagatactatagattttgttcttattattgagagtcatgaaattttaaattgatatctcaatataagtaaataaatagtgattagcaaatttagcaaccaccacataggcctgagatgtaacgtctgcaccacatcagaagccaagtgctcactgagttatacgagaatccaaatgctaagcagactgatctacagttgtatatttaaggagatatgtttaaataatgcaaatttcctaggcaagatacaggaaagaacagaaatgagagtagttactttagcatttcaataagaaatatgcaataagaggtttgaaacatgaaaaacagccaagagccagtggtacaaatgaaactacatggaataaagtcttgatgaatctgcagccgactctgcagaaatttttagctaattgtatctctgctaagctttcagaaggaaaacaaaacataagaaaacaagtttataatattagaggctttcttaaaacagtatacttttagtgtcctgcaaatcagaacctggtttaaaatgatgcctctaggtactacattagccttagcatccaaagaaagagctatgctgactgcgcatttcttattaaggcaggaaagaggcataatgcattgtagatttttcttaacaggattgaaattaaaaatgactttctggttaaagttattaactagaattaaattaaccaaaacactacttgtgcatcctagataattaagactatgttttaaacaggactgttttcttcataatcttacaggcgttaaatcctaataactttcttctttttaaacttataaacatattgatctaagcatgagtagagttaaccttcatgaaataatttcctccaaagaatgcatttgttttgtaatgctttgtttctattccaacgttccttggttattctgacttgtttgagaggaatgtacagatgatttttattttgccgcagggctgtcaatgcttttggttcacttagatcaatggcaaacttgcttaagggataggtggaattcagcagttactgaggcatgaaacattcactgtctcccatcctccatcagcttgatcttgctaatttcccttcatcctgctgtgctgcttctgtggcccttcctgcccttgtgtaggtgtttgtttcgtccgtctgatcttgtgtctgtgttgtccagttctccctgcagtttcttcctgtgtgtctgtttgtagatgaaggggctgaggatcaagtgggtcctctacacaggttccccagccatgaacctgccaccagcggggagaggcgtggactcctagccccctccatctcagtgtctgtgcctgatgatgacccttacaattccgatgaggagtactatgagcatcctttgttcagctcagaacggaccacctctagtgtgctccccagtgtcacagcgcagagtgcagaggcccacttaggccaggagaaaggtgaaccaagcatggtccccttttgctcctccgccccggcctacagctttgaccacctacatcatgttaagtgtgccttaatacagggtgggaggggcaggagcctgttttctctgcatgaaagtgaagttcctatataagttgaatctatccaaatgccttaacaatttatataaaagaagccttactagaggcatgtgagcacttcctttttctgtatcattgcttctgagaaggaagaaaaagagagagagaaagagagagagaagcaaaaaaatattccattaaagtatggcttctttctgctccctgccaataatcagctggggaagaacatattctttacccaaaccaaagaagatgactctgaatataatttttttcctccttagacacataatattactattaaatagcatctttaaatagcatctttaaatagcattagctttctttttagtgctatattaatatgatagatctttaaaagagaaagaatgaagaatctgtttagagcagaataaatgttatggaaacaatttatttccccatatcatgtaatcatctacagaaactacagaggcttccccaggtgactaaatcttggctcacatcagtagagctggactaaaatgaaggaaatgattcaaagcctttgtcattctagccttataaagctgggagactcaagtgtataattggttatcgtgaggataaaataagtaggtgatgggctgcaatgtgtctcattctaactaggtagttttggtaaagaaaaaaaaggtacagctaaatatatttttgcttaggcgaagagtttatttccaaaagggacaatatttaatatgaaagcagatagttctaaagcaataaggaataagcttacagctcaccaactatggtcatcataataaacgtcttcaaggacccttttgaaaacagaacaccaatagctcaggttctctgataaagaaatataacccctattaagtgaaactaagttcttctaaactaaatttctaaaatatgtgagtttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataatgtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagtgcaataactcatgaacttgaaaagtttatctttacatcttaaatgttaacttttttatgtgatatacatggtttggggggtggttattttggccgtttgattgccactcaattatctttccttggtgattttgttttgaattacagaaataagactttattactaatgtgcatattttttctttagtgtcaaagagaattatacatgaactacattactgatatttcagggagtttaacaatatgataatagttgtgtcccagaggtagacttttgtaaacagatttaaatttaaccttgaccttgtttttaacacattttattttacttactttttgaaaatgttcattttctccaacatcatacaatgcaatgaagctaacataacttgacttaggtagtcccttaccttggaaatgctaaataaattatattttaagtaaatttggtggactttgtgataaagctgttaaggtagttggttggatattcttttgaagcaaggctttttttattcccaaagatttctttagcaaaatttgcacattttaaataaagcagccgggaattcttatgtaggggcttcctgcattggcgaaaacagcacatgtctaacaaatttaaaggcttttttttttcagtacatcagtacatccatcttttcacaaccatctgttatccggcagtaccatctcttatttccagcaagctttccacatgcgtgcaacttactgccgtttccaataagggtaatcaatcaatacaaccctttcagctctcaaactttaaaataaattgccttttaatgagactttaaaagtcatcactattagcagattatacatcatagttttccaaccagtacctaatgtatgttgcattagaatattaatttgttcatcccaatggtaaaataaaaaaacagctgaggtcttcatgaggtcattctaatggagctgaaagtgttcctttagcaatatttctgtcgtttcatgtattgttctgtggtcatgatgtcaacatctttttcatccctaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggcttaaatggtggaatcgtttttgtttgcaaccgaaatgtgctatattttttatgcttcaatgaatactggtttgattttcttgacctcctgctgatgcttctcatatcattttctccccatggcagccagcccttctgatcatccccatatctcttgagttttcattcatctaacctttattagaagttcatcaagtatttttttttctattgttacaacaggacacataagtatataaggtaatgatgatccatacacttgctcttttagagatgattgaattttattatttttccccaaatcttttccagataactacatttagctctaatgaccacagtgaactactttgaccttaaaacacaagtgggacaataaagccttttggattgttgaataaataaaagtaaaaatgtgttatctaatttctgtgaagcacctctaaagccaatactggccaatgcttcaccagttagtcatgctccaaggattgaggtcatgaccatgggaataaagttatttcaatagttgactcttttgaaaagtttgttactcacatgacttcccagtatcaacagtgtaattcagattttcttatatctaccgtacagactaagtaatgattaggaatttaaatttttaaatatgtaatagaaactggcttgtaaattcttaagtcatatcatataaaattgatagcaaatatttacttatatttctgaaatttatcctcagatgaattctaaaaatttatgccagtaacctgtggatgcctaaagaattggccctgacatttgttaatcaagttaactgcaactattaacattatatcattgtgcattacttggccctctgcccatagcctaccaattcatttttaaatgataaaaccaatgaaaatgttcagtataaatcaattctttatctatatttagtccttactatatattcttttgtaccctaacattagctgcttactcaatattcattagcttataacttttatgtatagaaggcacatgaatttgtttcttctgtaatacacatcacataatgtttaggagagaccaaaaaaaaaaaaaacaaagaaaaaaagagaaaagaatatccagaaatatactgttcttacaattcctttgcacattaatttacaaccagagttcattttagtaatagtacacatatatctcagtcctgaccttttcatattgacttttacatgggtagcatgcttgcatgttccataatttttgtttttattctaccattcatttatcacttcaaaatataattttaagcttatttcctgaacgcacttgcctattatttgtttaaaaatcaacccgattacttcagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaaggtgtgcattattattattattattttaactcaaacacaataaccttatgggaattttttttcacttaaacattttaaaatacctctttatctctttattttgtattttgttaaatatacaaaggattttgtacacttgttactaatgttttcactgttgttgttgttgtcatgatttgctttgatccacagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaaggttcatttaacaatcacttctttaaaaatgtttttgaagtaattcattattacttttttgcagaactgcctaacagtggtaactaattatttataaaatttcgttcggttttgctccacgtgtttattttttcctgatggtatgctttttgtgttttcttattcatagcagtttataagaaggctgaacttgctaaaaaaacagaagttcaggcccactctccctccaggaaattcattttaaaacctgctatcaaatatactagaccaactcatctctcctgtgttaagcggaaaaccacaggtgactgttcaattctgcaatgtgactggcaaacatagacatgtattttttttttaaatctcattactgtagcagcttcttcattttgtttttcttccaagaatctcagcagtcatgaacaattttgctattaagtgtcttgtatcattattcttttttcccccctccttacagaaaaggtcatgaccatctgtttctttgtcatgctcagacataacagtgcgtgattgtatcttggcattgtgctctagtgtcacgttctggggattcctattttcattctgtgtgtttggttagacgatggcgatgaatttaactgtggtatgcattctcattattttgcttatttatctctctcatgcttaaacccataaatatttgtcctattttctacattgttactgccaaatctgttactgatgttgatgaatttattgaaaaccaccaagaatgtgtagtgatttagatactgaaaatgaaaagcaagccaggaagtgaaattgtggtttgcaaaattactattactttgcttttgctgaaaaaaagaagatagaaaacaaaattttctggtaattatatcagattttattcctcatatccaaaattaacaagattttcactctactgaactacatctcttagctgacattttgtcatggagatttcttaaatatgttggatccaaactgctcgacttttctatataatttagtttcacaaatttgaagctaaaactcttccttttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccggagtagctgggattacaggcgtgcacccagctaattttttttttttttgtatttttagtagagacggggtttcaccatcttggccaggctggttttgaactcctgacctcgtgatccacctgcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaacttttttctaaatttcagggcaaagtatttattttatatgtttaattatactaggataatcttaccttacactatattttattttagcatttattaagtggcatgcttgtagtctacaaaatgacagattgctaaatcagaaaagaatgtttttctttccattgtacatcatcaatgcctctatataaatcttcggatggttttaaaggttaagaggaacattagcctttgtgagaaagagaaaatcaaggtaactgatggttttattttagccattgaaaattccaagtattttgtatttgtgttcttcatctagaaatcatatcatgtgctttccttcaaaaacaagaatctaaggcaggatttgaaaatagaaggcttgtatatacgcacaccttgataaagcttcaggatgaagaatatatctgaagctaggagttaggaattaacgtgacatacctcaattcattttctcaggtttttagcttcattaaacttagaacttcattaaacttaatagcaaattaatagcttcattaaacttagtagcaaaattgcttgggcaagcagaatctcttgatttagcataaaaactctataacctacctaaaaggatgaaagatgtcatcaggattgtggaattttagagaaaacgtaaaatggtttagtaaagtgtttacatgtcattggtattcaatttgccacatttaaagtaaattgtgtttttattcattctttgaaagaaatttaaaatctttgaactaatgaagattttcctttattctggtctaatgttaagatactttaggagaaagcatgtatcagatgtaggtgtcattggtttgaagcaagctatacatgtcacaagaatttgagttatattacagagatagtagtaaggcatcgttttcactgcttccttaaaaacaatgagtcctagaatctgaaaaatctcactagctagtcctacatggcataaagcatattgtagacagttattatgtttgtgtcagaactgtacctgtcataaaaatacctttttagaacttattcagagggcttataaggatacattttttttctgagggtttctattttatgaatgaaaattaaggaggaataaacacacaagcttgattattttatcttctaagcccaattttcaaacatagatggttttccaaaccacaagggattgttttaaatcatgagagctaagctacctcaggtaagtcatcaaccaaaatgtgctagagataatggagtttaaaattgaatccagaagcataaaacagcagcaagagaaacaacagtaacagatgtggtaataatttcatacaggaagtgcatgtgtagaacatgttctgtatttactgaacttaaattttctctcgtgttttctgttcttgacaagctatttttcttcccttctcatgtggcattttcacatcaaacaagtatgtcattcatattgtgaaatgaagggatacaaagggaaaggggttagctgatcatgacagtttgaaatgtaaaataccgaaatatctatggttatgccagtggcttccagaacaagaagagggtttggaaatctctatgaaccctcttctatatatcatgtgaaccccagaaaccaatcagtgttctttttcttaaattttgcaacattcacattgctattctgtaacttctgttctaaaggatctccttacgtactagtgattcaaagatacattggtaatcaatagaaaaattacgtggtgtgcttacctgcactttggtagacaatgggttatattaattagcacacactatttgttggagccacatgctatgttattgttattcatgttacttgagttattgaatttgagtctcataataagcaaacttttgctttgcattagtctgttgacacaacagaatatcctacaggtatttaaaactgcatttatgactttttagcaactaagtttggggttgtttgtcttttattttcaacagcagcaggtggggaatcagctctggctcccagtgtatttaaacaggcaaaggacaaagtctctgtgagtaaaataagtttttccttgttcttcatttgaagttcctttggtattagctgtaacatcagaataacttttgatattgtttagatatttactcttaaaagtcactttaaatagttcgctcacccagaagattctccgtggcatccaggcatggaaggatgaacgtcttctgggatggcgtatgatggtaattggtgagggcacagctggactgcttccttactagtaagacaaaaacatagaaagcagcacaatgatatggcaaaagtaaggaagtccagtttagttacttttcatagaatcaaattaaaccatataatcaacagtaactgtattttataatacactttcattgtttttgttacaaaatagaaatatgaccaaatgaagcactgcacacaagcagaaagaagtagaaatcaattataatcctcttatcataaagataaacacagctatcattttgatgtaaaatcctaatttttttctatacatttataggcttaacaacaaaaatgagaacactgtgtatcactttttaaattcaacagtaaatgtacttccatgtcgttgaacattttgtaagttttaatgactacgtaatactgcattttatttctttgcaatgatatacttaatcaatttcctattatttgacttttagaattttttgttggtattttaacaatattactgtagagaactttttggctaagttcagtttgtatgctatttccttcattttctactagtgaaattattgtttcaagaaaaatgttaatatttaaagtttttgctgcatattgtcaaattgccctctggaaaggttctacccacttatacattctgtataaggagagtgttcatatttgttattattactacatattttatattgttgttgtatatttgccaaattatagagatggcatatattattattttaaaattttattttggttgtattaatggtgtttaacttcttcatatgtttgtaaatcttttctattttttctgtgaattttatttttatattattaactgtattttaatgaccaaagccaacatgaagtattttcactcctttatgattgaaagaaaaaaattaaaaggctactaatgaaatcctaaaattataacaaataatttgaatgatattaattagtagcttataacaacattctgagactgagcaaacacatgtaatatgtaaatcacaattcttagcttacccttctaaaaaaccaataagattttagacttccacttttatttattatgaaaagtagtgagtgattcatttctttgatcttgaacctgaggggttttatgttgataaaagatgatacttgatttttatacaaatgtttcagatatattcctgaacatatggcaagcaacagaattcatttattgctttggtgaatattaggctttattataaacacattgtgatttcaagatttgtatctctttaccttctgtttccaaattaatgatgtatggtggttggccgtagggctatgaaacaaatcatgttcaaatcttgaacatctattagttatatgatccttttcttcctatttcttaattttctaaaaataaaggggaggacaaaattcctgtctcatgagttagttataaaaattaaatgtaatgatgttataaaacagtatgcagtataatgtttagaacatagcattcatttaataaatggtaatagttgttagttattattttagttaactgaatggtggaagttttcaggagcagatatagaaaataagtctgacctttcctcctttaggttgacattatttggaacatttttaggaaatttttaagccccttggtctttgagtaactcgatagaatcagcacttggaacagaaccataggcatcgtctgacacaaaacaaccttttttccttgtaaatgcccgtcttgtctttctgaagcaaaattagcccttcattctttctttttttctcatttattagtctttttttcttcctaatcccatatccttgttctataagttttctaaaaccccgagtaacttttatttgatttagctctaatgttcagtatatccatcagtactgttctctgattttttttggtagttgtatgctctttcagattcactttttttaacttaaaaattttttttctatgggtacatattagttgtatatatttatgggatgcctgtgatgattttttaaattgctctttattaggaaacagacccacccataatcctgcatttcacgtgggtttttctgttgtttgtttgtttagcattaatagttgtctttcttaactacaagcaatccaatttatttttctcttctatatcacgcttttgaaattcactcttttgtgggtaggatcaataaaaaaagaatgacttgtgctgacccaattacacttcccactcaagatactgggtctataaaacaagaagtgatttgtacagtctgtaaatacttatgtcctgttgtagccacagaggttaaaacttgagataaaaatctcagttttatctgtcatttctgtaacagttaaatcaaattaattatttgaagataataatctccttggctttgtcatacttatctatatttttaacagtcacccatgagacatatggcacgctggcatagctttctccaaaagccatacatccttcccaattatacttgcagacagtctccccaggagttatcaacacctgtaaattaagtcgtgatttttattggccatcttttcagtcctgactttcctttttagaattcataacacatcatgcagactctagtctttgcataaaaatgttattagttctatggtataacttaatccacagtatgtgtttcacttataaaatgaacaaattatatataaactctgaaaaattctgttgaagtcaatgtagatgacgtgaaaataaattttctcaatctttaaaaatacttttttcattattaggcttcaaatataccttgttccaaagttcttgaaacatgattaagatatggattatatgtacaccttaaaggctgtgtttattaaaggaataattccagcagataggatattgaaagatatttccaaatgtgttatcattataaaacttatgaattaattagagactatatacgtagaatccaaaaagaatattttatatacattatccttaaattagagaactatgtatagaatcattttttaaacaacaaaatttaagcactcagcattattttttaaacctgcaaaaagagagttttgctagtcacttgtaacattctttctatattaaggcttattgtatttttaaagagaaagagagacttgctttggtctcaggatttcacaaagctaattccttcatatctaagcaatattactctttcttctgtccttctatctatccacccactcatcatttattcagcaattatccgctggttctctactgcgtaccaaacataaacaatcacatttggaagtaaagaagagcaagtaataagtaataaacatggatacctgttctagacctggttaatagaaaataaaatggtttagcattatttttgtgttttatttgtataacagattttttattttatttttaatcagggtgtccatgtgcaggcttgttacaagggtatattacgtgatgctgaggtttgagcttatattgattccatcatccaaatagtgaacatagttcccaataggaacttcccaataggaagtttttcaatccttcccccacttttggagtcaccagtgtctattgttgccatctttatgtccgtgtgtacccattgtttagctcccacttataaatgagaacatgtgatatttggttttcttagacatttttctatgactattattaagttagttttggctaaaaagaactgtgaaaatctcttctcatctaagtacacatctctatcattgattataaccatttatcatgtgttcttattaaaaagactttgagtttcttatatgtttatacttcttttttatcttccttttactttatagtttggtttattttgtgcttttgtttgttttctttcatggctagaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggtaaggcggcaggtcaataaaaggtgcagaaagaaatagaatttgggagaaggttatgttatagaacctaattcaggaaatgtatgaaagcaaatactttactctgaagtgtttgacacataaacagtaggcccttttaaaaacaaatacaaatttaaaattttgataaacagtatacctattttttaaatgtagaaaatatgtctttttctagatatgctacccattattaatttatggtttgattatctggtaaaatatcaaatgcaaactaacaaaacaaaatatattctattatatataatatataagaaataatattgtacagtacaataataacaaattacattgtatagaatataatagataatttaaactaaacgtcatatacatcagggtttaatactatctctgacacctaccaactcaattgtcttgaaacaattatataaactcattaaacttgtttcttcagctttaaaatgtgtatcatgttttgtggtgagaatcaaatcataaaaggatataaactataaagggttcctgtcacatacacgcacaagatatggtaatggtcattgttagaaatattatgcatgcagtgagctactctcagtcctttctgattaataaattatcatgctaatgaagatttttcaataaaattagtaatttgctgaagattgagtacatttattttaccaatattatcatttagaacttgaacttcacactcagttattagaactccaaaataatgtatttttacaaaacatctaggcaaatatgcactctttctaagttataaagtagaaatgtttataaatatatgaaatccagtagtttgtattaaaagaaattcatttattagcacaggaggaaaatagcaaaatcaatatcacttcgtataaattaaagagttacaagaacccaatgttctttttgttttctccaatcaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccagtaggtttattttgatttgaattcctttttaagcactttttaaatcctttaagtggaatagcacttatatttatattttaatttgtaaaaataaaacatgcattaagactagattatatttgccataaggatcagaaaatccagaatgtagatggctgcaaaatagctgtttgagtaaaaacaactgatggaggaaatggtaacatattaccctattatctaagactgatataaagttatttctctaagaatatatttttctttttgcttcaaatttagagcagaaaagaaaattctaaagaagtaatcaatgtagaaaccaagtcaaggattttaaaaacatacatctataaaagcttaacacttattagatttccaagttgtaaaatctaactagaaagtcgacattcaaaacttaggatcctgttcaacttcttaagaatttgcattccaaatgagctataaatatagcatagtctatgcaataggttcaaattatcttgattgatggcccattcatgaactgattggcaattgtaacagtttatataatgctccaatcattacacacttatatgttgcattgtggcaaactatctagtaaagcatggattcaaattacttccgtaaatatttttctgttgcaaccaaaatagctaccgtttattgagcacatatagatactaaactcttaagatacattttttcactaatttaattagcaagactaatgactattataataattaataaactcaattcattctactgatgagaaaactgaccctctagagagggtaacttgtccagttaccctctagagagggtaactgcttcacagttcgcaagtggttgaatttggttttcagcctactgataacttcacaacctgaagtcttaatgtcttttctacatttattgggaggaaatagtactagagaactgctctgtagaattatttggagaagagtatctgtgtcatttaagaaccattttaaaatggtggaaattgctaccactatcacattatagttgacttcaacacttattttgataataattggcccacttaaatatgactattggcatttaaacagtgtttttgcctacaagaaaagtgtttattataataacagtaattgtgtccaacattatttagtttcctagagtattagcatcctttgaaatatgtgttaagaacactgaaatcacaaaaactcttttatcatagcaaaaataaattatttgaatgaattagcaggaaggtcatttaagatttagtactctccagggaagagactttaaatctctagagttgaaattgaacataattaataaccccaaggatgtatgagacaagacaaagataccaagtactctcgaaaggaacatcttgaattatacttgtatttgttgctataaaagcaaaatggcactttctccataaatccacttcttcaaaccactgtgttctgccttttaaagtgtatctatatatgaattgattcattaaatgttcagcaccaattctattttgactttttaaatttactgatgtttacaggcattttgcattgtattatttgatagtgaacataactaacacattgataattttaaaacataggatctgttttacctctgcataccaatagctgaaaggcataaagacgattggaaaagcaagcactctgcccacttctacttgtgcaccatccccttaatggtacacagggatgttctaacattttgtgcagctattgaaaagatttgaaggaaacaatgttgtgcaggaagctcatccgcccaagaggaaggaaatccattgtcattgaggagttgacaagataaataaaagcacagtttaatcaattaacttgtaaagaaatatcttaaaagttgttttagatcttaggcttaacctcttcaagttcagaacaaataagaaacattcaaatttattgttttgatgacaagaacatatttattacaataaaaattggtcatatatattgaacagcagtgtgaaggccttaatatttgtagtttatcttctttctccagatgtaacataaaaccttcttttataaagcttaacgtgttttctacaagtatggaaatgactccttagaagtttagaaaaaattatttcatatagtaaaaattgttattcacatccagaatattgcttcaattcagtctccatgaagtcaaaaaacccctcagcacactttgatgaattctgaattattaaaaaaatatgttgtctacctactgttttcagctcacatgaaagtcaccagggctaggtacaatggcaaaaaatacagggatgatccctctccccagaatatctgagctattcaaaactggtgaagtaatagagaaaacattcaagaaagaaataatgtttctggagaaagtattcagacagacatagagacagacatctacgttacaaacttagtccataacaaaccaggacatggaagttacaaaatgccaagttggatgtggttgtgtcatcctagtcttgaaattcttgtgaaaagcaataaaaatcacagaacacatgctaatttctcactttagacttctcatatcccatttcatattatcaattgaagagtctaactatcttgtgccctgtgttagaagaccaaaaagacacagggcactttcatttgatacttgaaaactgttcactgaaagaagtaaaattcttctgtgtttctccaggagatagaacctatggtgatgggtggatttacattttccatagattacaattgtccaagaagctctcctgagctcacatcttgtaaatatttaagcaaagattacatgtccacttctcagaaagaacttcctatatttatgatcaattgcattaggtgacctctgagattcctttcacttcagtggctttaaaattgttatatatttattctctacaaaatttcagaagattcattgatttttttacttaagcagcagtaaaaaatgaaaattatcccttttctataaaatatgttataaatgaaatttgcatgcttaaaaatgtaaatcctcaggggctaaatattgtatctggcttagacgttagtagcatctgggtgaatgagcctcaatgttctcatttcttaggaataataagagctgcccctaacaactgtattgtgcatgtttgtttggttatcagttggttggtattcacataagtgctttgaaatttataaggtgttgcattcttatttctatcattctttcaggaaagtatttgaaatgtcattcaaagcacattcaaaagatgaaagaaacatagtataggaaagtggggggtgggaataataataatatgaggctgagctcaacttgaggcaaagaaatgcatctcagatcctgtataattaatgtggttttggatttaactctaaactgccaagctagtgatgaaaacagaggagaaaacacaatcaggtacgaggctcactgggaatatattgttgagacatcccaagtttctaaggcaagaaacagactttttttttggtttgaagcactgagataattttccttatgaaaagaatacatgatatagtatagcagtgtctgacagcttccataaacacatttacacctcatagtgttcctcagtataaggatataatattgaaatgcagatctttctatacaggccaaaactatgtgtcctaaatacatggttctatattgtatgttcacctggatcccagaatgaatttactacatagaggaatgaatgatctacatatcattcaaggaatcttcagtaaatatgggtctgcatacgacactaagtgtaaactctttccaactaaaggcagatccatttgccttaatagtcacacaagtagaaaatagtttttgacacattcataatgaaaattacggagaacaaatcagaaaaaaaaaatcaggtttttttctttgtgttgatagcaatgcatgttcaaaagaatgccaccgggttatgcacctgatttcagaaacgagactctcagcttcttgagtactatagtgataactgtttctaaataccttagaaattaaacgtattatgacttctaacaatctatgggaagagggatgttttgaggagaattgtctgactctggtttggttttggtcttgcttgttaatacagggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtaagaattgcatgaacacatatttgctgccagaaataattattacattgccttcttcatattgaaaactaacagttcttaaaagggaagcagaggtgttaaagagcttggttacaatttattgctaagagtttggactttacattaggaagatagcctctgaaatacaacgaaaatcacatgacatgcccattccttctgtttgttactgggtaaaaatttttaccaacttttagttgattgactaactttttttttttctgaatgtatctctattgctttgtgttttttaacttgagattaaagttatatttctgatataaaattgagttttctattttagtttctgaccatgagctcatttggctatcttttagtgattccaattttatctcctttcttccccaaggatttcctatgacattttctaccatttcctcatgtttactccaaaataaggatgtttcaccgagtttcaattctggctactattgcctaaatgttgcaaaggggaggtattcgtgttgataataaaagacacatggttctgatgaataaaattgtagactttgaacttctattcaagattaattgtattaaatagagctattagtaaagcttacttactaactcttaacttcagctccccagagcaaacattcatatcttttcaaaccagggggttttgagttctgtcttgacctgaaccttgcttatacactacatgtttggacaaagcaattagcctggaaggaaataatacaaatattatttaatgtttatctcataatattgatctattcaggatagtttaacttttgtcattgaagagatataaaacaacatccttttttgaaagaaagaaggacaaaaacagtaactttgtacataaacgaacttataatgccctttcagtattccaagaaagtctttcctttttaacgtcaatatttttttctgccactctttttcttgtctcttgtattttgtgccactgctttctggtatctctccttcatgccaaagaaaatctattttcaggaagaaagatcttgccaaaatgtaaagctatcaggcactcctactcaccaatgaagcaacaattcagtgttgctctttcatttagcaacaaacttctttgctgtctctttatggctctgtaagggaaagcccaaagagttaagaaaaatcaaccaatggggcaggaggggagaggtcaatatgcccttttagaacaatgataacattctataataatagagtcatagaaagatactttttcacagacagatgctatgaaaactagaagctacaagaaacatttttaagcaaaaagtagaattataagcctataattcctaaaaaactcaaactattcttgcgttcatcagagttttgcacatgcaagagaaggaaatattttgagctttttggaaatattcaaatgttgcatcatctttatatttatacataaataatttaaaagtgtaaggtgaataaaatcaatttagtaccatttggaaagttctgcattttagccttggacaagctatcctctaaaatagaataactattatgtatatttaaaaatcagttcttttaaaataaatattcccatgtcctgttattctcctcaactagatatggggtttacttaattatattctggaaaacattaatacttaaaataatttgtttcctcttagaatcacaagaaaatacaaattatctccaagatattgtattaaaactaacaaaagtaattaaaagagaaaagtattattttaagttgacatagaaattttataatatatgattttctttgaaggactccttaagaaaggcaaaaagaatggttttagccccagctttgcaggaacctctaagattcaatcaacccaaaaaatgtgaagacgtctgttttctttttctgattctttatcatatctggtttggagtatttttatgtcttattgtaattgacttctatatttggtaattcataaaattgatacaaaatatctcatacttttgagctgaactaaaacttccttagagattatggtggttaaggactagtaaatacatatgacacaaaaattacagaaagaacaaaaatagcttcaaaatcacagtgtcatttgaagcaaatatgtttttatcatcaggcaagtgttaacctgctacaaaattatcctacttcagcaatgatgactttggaaaaaatccacaacagtggagttatgaggtaacttttttgcagaagtaggaggtatttcctcaccaagataaacagatgaaagatatttgccttctattttgtgatagatggtataaattcacttaaagggtaaaatgaattgggaaataatagcgcattgcaattgaactgtctttgtaggaaaaacatatcattcaacacttcagcactctccccttaaaagcctccttacagtgtgtgatctcagatatagggagtgaggagaggttttttccatacttgtaaaactgaagatcttatagaacgactgaaggaaaagtattttagggcttcttagaaattatcaaaatgacatgttaaagacctttattagatgatcgagcatctatacatgcataccgttgaagaaattgaagccactagcacattgttctcaattgtaaattgattttcctaaggcacttgaatgggttggccaacgcagaaacatttaaaaagacagaacaagagctatactttcttcacgggccaggttttgtaatagtgatatatggtctctaggaattcagaaaaatattcatgtaattcttattaaagaagatgggagtaaaattaaagatgtaactttaattcctctgcacagggtctattgtggtaaaatttgaagcaattaggttgtatacaaatgatttaattgtgaaaacttcattattggggttttaaaatttgtgcaatctctaaaaattggtagaggaaatctataataaagatatatgcatcttaggaactcaacagctttccaaattatttgcctgcagtttgaacattaattgctcttctgtatgtacaggttttgtgcttaacagcagctatctcttctgttaaggtccaatttctgttggcagaggggctcagctcagtgagtcacatcaatgcctaatggaatagataagctagctgaagatacaaggagctttacagaaggcaataaagctaatcttttcagctaaaacaaattcattctattggaaagaatatgggcaatcatagattcagtgtagataattagcttgattgatttaactcaaggcatagggaagactatcttattaagtgtattaatttgaaactgctctatgtagctagcctctcaatctacattaaatctaagttttagaataaataatgttagcttttgaagaacacagctgcttcagttaaacaaaggtagagaaacaagcaatttctctaaacacgtagcataaaaaaatttaggtaacaactcaaggaatagtgctttttgccttttctatctaataatcaggttttaaaatagttacttggatttatatggaatgctcctatatgttttgacagatatcttgtttttctccattggctttatgaagatgagtataaaaagcacaagttggccaggtgtggtggctcatgcctgtaatcccagcactttgggaggccaaggcagcgggtggatcacctgaggtcaggagttcgagaccagcctggccaacatggtgaaaccccgtccctactaaaagtacaaaaaaaaaagaaaatagccaggcgtggtggtgggcaccagtaatcccagctacttgggaggctgaggcaggagaattgcttgaacccaggaggcagaggttgcagtgagccaagaccacgccattgcactccaacctgggcaacaagaatgaaactctgtctcaataaataaataaataaataaaattttaaaagcacaagttatatgcgcttgtaataattgaaagttactaaagaagtggtttcacagatgttgttttcattaactgctcattggataggatagtcagttagagcataatctctgcaaggccatgtctgtggatctgattgattgcctctgaattatgtgcttttgctccattaatgactacagtcagtcattttcaggttagctaggctacagatggtggcatcatcatgcaagtcactcctttttgaagaaaaaacagtactcactttttaaataaagaactttgtaaaatttgtcagcatattgctttcccaatcagcattggtctgtcatctttgtaaaatttttatttagataaatctattaaactagaacctgtaaaacatatcattacattctagaaataaagcaatcttagtttctatatctcagttctatatggatctattaaactaaaggatattagatgtcagagatatccatctccttctaatccaaccctcacattttcacagagtaagaaacagaagttctcacattacctgcatcttgcatataggacattaaatatcatccttccatggctgagctgtgaagtcagagtctatactttgtctttaatgaataattagtcacttatctgcaagtatgtaattttgtataccttagtcttctttgtttgccttacctttcatttcataacatgaaaataaatggtaattttatttagcagtgttttccatgccaaagttttttttaccacgtcaggattgaaatttgaagcttctaaacttttattatattttcatgaaataatttaatgcaaatagcatgttatattgatacactattaaaatacatgttatattaatatactacattaaatttggaaaggtatgttgcattttatcatattttttgttttctcctataattgacagttattttttaaataattctaaaaattaaggttttaaaatagaagctagttagctttttaatttctaaggataatataaagaatcaattatgaaatattatagcatcaatcttggcatcttaaaaataacatggggagttgtctcctattactttgataattccagaaatacaaagttttacctttctttacttgaccattgagtcaacaaatatttattgagcacctactacaccatgctatgttctacatactgaaatataacaacaaacaaaatagacatagatttcttaaattcttgccatcatggaatttacattctaggaggaaaggtgagcaaaaaaaaaagtgatataagaaaaatatgtaaaaaagtgctaagtatggagaaaaataaagataagaaagaggctcaggatatgttaagaggaaattgcatttctgataagatggctaggaaagtcccgagaaggtgatatttgaatagaagctccaaggaagtaaagaagtaagccatttggataactaggtaatgagcctttcaggcaaagggaaccacacatccaaagaccctgaggtagaagcaggcctaacatgttctaggaacagcaagtacatcagtgtgactgatgccacatacatctttgagtatagaaagtttatgctattattacattattatttttagtattattacatctattcaaataacaggactttcatattgctaaaccaaaaatctaagtgttgacttttcctctcactttctctcatcccatatcctaaccatctgattttgtgccctgaatagctcttaaatctggccatttcactcagtctgctctgcactaccttagcgcaggatacatgatctcttgctgatattgtcgcaattgttattaatttttggtttccctacatctgttgtttgctctatctgatgtactctctatactgtaaccaaactttctcaccacatttttcattaaatattccattatataattagtaatttaatgtctatcttgtttcacttactagaccataaggtccataaagtcagagatgaggtgcattttgtccataatgtcccatacatagtaggtgctcaataaatatgcagtgaaaattgaatgaatgtattatgccatattcatggagagatgcattcttttagtgacaccgttgaatgattatgaatgttttatgtcatgacagttattatccaaagaaactttccatgtttgtctaaaacaagcttgtccaacccatggcccttggggccacatgtggtgcaggatgactttgaatgtggcccaacacaaattcataaactttttaaaaacattttgagattttttgtgattttttttagctcatcagctatgattagttttagtgtattttatgtgtggctcaagaccattctttttcttccaatgtggcccagggaagccaaaagattggacaccctgatctaaaagaatattgaactaggatttaagagctgagttagtggtccagctcttctattaaagtattgcattaccttaggtactgattttttttttgtccttatttgtagaatggaagcaacaaaatcatgcttgtttttgtatatagcaccatttcatttaaatagactcttaaatcattttaaattctcacatgcatggtactacttggagcatgatagtagttatgcattacagttcatcaaaaaacattcatttaggtattctaatagattccatatatgtttgtgccacaagggccagctgaaattgagtaaaagagcaggtttctgaaatagaagaaaggtgtcataagggaagaaggagacatagagagggaggaagaagggaataaaattagtgaaatgtagggtggaatctttttaaatatattcttataaagttttaggcattatctgtattagtctgttctcacattgctataaagagctacccaagactgggaaatttatgaagaaaagaggtttaattgactcacagttccacaggcttaacagggcgcatgactgagaggcctgaggaaacttaaaatcatggcagaataggaactttcactctctctcctgccaccatgtgaagaaggtgcctgctttaagggaaagcagttccacacacttttaaatcatcagatctcatgagaactcaccgtcttgagaacagcaagggggaaatctgcccccatgttccaatctcctcccaccaggtccctcctccaattcaacctgagatttgggcagggacacaaatccaaatcatattgttaccctcggattatttgtaggccctttaaatgctaattacatagtttaccttcaattttatatttaagaaaatggattaattctggaagcaactaataaattatagtgaaacagaattttccctcattatatgaaattataatggttaccactatgaaggtctactgggtgctattaacatgtaagcatatttataacatataagatgaagagagaaagattgcaatgaatctttttctcattcacatatttattctttcatcaaacatttactaagattgctgggcattaaatgacaaaagggcaatgggagacaatgaggcatggtctctgcaatctaggcaaaaaggaggttttttgttttttgttttgtttcttgtcctcctctaatgtcttccccttatttaattttaagtttttttccaagccatttcttcacatcttcttagagctacaataagggctaaataagaggactcataaaataccctacgaacttgtaaaaatactgttggtcaacacagcatgaagaaatttattacaaggcttttgtttgttttgttttgttttttgatatcaaagtcatcattatatcagagtgaaagctacttaagatcaggactctgtctttatgcaatagaattttgtaactataaatcaaatgtcttttgtggagtaatgaaaaggttttgagctaggttgagtaaatactaatttttaaaaattatgagaaaattaccactttgggtttgcaaagttgaggcttgttgagcctttttatctactgttcattcacaagccaaacaaagacacaggaactaatgaggttattttcagataactgagcagactatttaacaattactttctttgatgacttcgtccactattccttagaatttcttaaaaatttaaacaagaaaaaatttaatgtcaaaaaattataatatacaaatttgaaaaagttcattagctgttcattttcatgaatcaaaatgactgttgtactcataatgtttcttccagcgcccactgagagaccatttacaaatacgtaaaaatgggtccagtgactgaactcattaatgtctattccactaaaacgttctttccaaattcttcagcattatctattcaccccgggcttttcagtgtggttctactttctgtgccatgcgactcagcttgcgtaggaaaattggtctctccaacttttcttttagagttttgtggaattgtgcattttgacataaactgttatttcttcctaaatgtgtatttaaatatacatattgtttatattggatataaaaaattttaaagaaactattgttcaatgtaggcagggatgattaaaattctgattataatgtctgcatacattttaaccagagtgcaaagtttttaacagatgaatctttgaagaacatcatgtgtgccagagaactttcaatcttcgggaatatctgatgtagtcatagtttgttttactataggatacttgaggattttatagaggcgaaatagttttccttaaaatgaatattatgaaataaaaaatactttcgaaagagagagaaagtattttcataatgcaagaacaaaggaaggcttaattttatgccatcttgagaaatgagggaaacccaaaggagaaacttaatcccctgcaaggttaaagggaagtcagttgagtgccactgttcactcccccttctcaaaagcattctttctgatacaactcagatggaggaagagagaaacggtgttgcaacctaggttcgtacctaatggatgcctgagggggtctagacaaatccaaattatttgactcctagtcaccctccacatctcaccacgttgagctgacgtgtgggtcttttgttaaagagagcagtgttagagtcaatttaaaaataaatcaaaatctcattgctcaagaaattcaagttgacattgggatgaatgcctccaacttacaaattgttttactaaaaattgtacattaagaatgtattttctttcattttacgtttcttagtaagagagatgtttttttcttgtctgcaggcatatcctgcattttctgtttcaatcctttcctagagcaaccctgttttaggggaacaggttaatttattgaaagaaacaattaaatatatgcagagagagagagcaccgtggcagatcacttcaattaaaccgtggtgataaaatccaactaaagtcacacaaggaatatccagaaagaaattacaatattcttctctatcatagtggaagaatagaaagaattagtaaaattaaaataaagcaattctaatgaattttttaatgtcattaacctatgcttatacaactcttcatgctatatgacccttatgtgaatggaaagccaactatttgtgcaaataaatcaccaatgtttgcataaaattcatgagactaaaatccttttttgcaagctcccactggaggtattgattgcaccaaaccttaaagaataatctgttacagactcaaattggaatgagagcaccctagggagagataataacataaaacacagggatgaactttaaatgtaaacacaggccttaaagtatagaatatagcagagtctggccaaaatgtaaagtaacagagaagtctgaagaatcagaattgctgagacctctggctgcctcactaagaagttttgatgtatttaataagaaatagggtgcttgggggaattttgaataggggagagctataggaagatgatctggttgattaatataatatttttcacttctactatgaattatgtagaaaaaaagattgtcacactctttcaaattacactactttgtattaatagtgcaagtaaaaattttacttgaaataggccgggcacggtggctcacgcctgtaatcccagcgctttgggaggccgaggcgggcagatcacgaggtcaggagatccagaccatcctggctaacacggtgaaacttcatctctactaaaaaatacaaaaaattagccggacatggtggcgggcgcctgtagtcccagctactcaggaagctgaggcaggagaatggcgtgaacccgggaggcggagcttgcagtgagccgagatcgcgccactgcactccagcctgggtgacagagcgatacttggtctcaaaaaaaaaaaaaaaaaaaaaaacttgaaataaattggcagagattaaaatgtgatttagagaaaattttgcgcaattattattcagattttttccttcatatcatgagcacggaaaattagctttttcgttaaatagtagttattttttttctagacaatctctaagatgttaaaataattttctcttgacataggtttttaggaaaacaaatgtttttctaaaactgaaaatcccttcccaaagaaataaatatttatttagatttatccatagaacccagagttaaaactataactctttgatttttttttttttaaactgatctggaatatggccttctccttcacagcagccacaaatttttctattttatgaaatggcttctgaggactgctgttatttgtggaatgaactctaagatgctaattatttgtaattgaccctagagatctttggtgtgaagtaatttgtaattttgctacggcataaatatgagtcacgcggaataggcgaacattcaggtgcaagttgtcaagctagagtgtaactcttcatgagcactaagtgtccactatccaaagaggtttatgcttctttctaccctaccattaagcgcgatggaaaacaaaggtctagagaggccagttacatttattctgtcataattcacctcattttagatgaaaaaattataatataaagctattgcatatggaaatatgtaaagaaagtgccactaatgcatgtgaaaggataggattgcttcatattacaagttgagcagatataggtggagaaagtctacctgcaagagaggcaagcaggtttttttgatagaatatctgtgattttctagaaaatctgggtaaaatcaacagaagttagcttttaagttgtaggactttaagattctaaataatctcttaataatgctggcaatgtgatcatttaggattgaatcatttgttttggaaatcataaaaatgatcaaacagttgattaaatgttaatgtcaaacagatttatgcaactgattttagaatttccatttttgtaacaagtgaatcagatttcatgtttggcttgtgatcacttggcaatgagtcaccagattggtactctaatgatctctaagttaaattttttaaacatagtatgaaatcctgtatattctcaaggattagtaaaatagctcacatcatgtctatgtcattgccaaaataattagatacttattgagaatcctttaaagtattattattagaaacagtaagtcaaaattatttgctttctcccatccgagtactaatcaagcccgatcctgcttaaattccaagattagatgggaatgggcacatttatggtgatatggccataaataaaatgatttgcctttagaaaataatttctctgtgaggttttacatgtaatggtctttgttggtttaaaactatctccgtcttatgtgaaacatttatagtgcaactacacttattgttagatacagactctgtgaatatcttcaagcctgtttaaattgcaacttttattatgccctaaaaagtagcccaatcattctgtcttctgaattcaaattttgacaagaggctctccccgtgggttgctgatgagagatatcaatgatatttccctgcaagggacaagctatcttgtcaatgttaggcaggcactgtgaattaagctttgcctagttaaaaatagtcaggattcaatgtctttttgaattatttattcttttttggaaataccaaaagatgtggtaatattcttgcagatggctgtgtatctaaggtaaatttatttagaattttttaataagaggataaagtgtcccctaaagcattgaaaatgttgtttttttttctttagctattgcagaggtggggaagagaagagagtagaagtagccaaagtaaaacaaaatgaacaaataacgacaataacacaaataaagctttctttccatgcttatattgcttatgtgtcctccaaaagatgcaaggttcaaaagacatatgaaagaagtcatgaaagttgtaacattttacattaaaccagagtaatgtccttccagatctggatctgctgttgtcttcaagatgaatgtttgacttcccaaaaatagaaataaaacacctaacctcaaatctgctggcctcaatcaaggcctgacctatgtctgtatgacctagttacaagtcagctaaccaatgggcatgggttttctttcctctaaaaatggaaataatgcttccatatgatcatccatggaaaatggctgctcttgagcaattgccagaaaggggccttcaggatgtcgctgaaccacctgcaagggaattgtgaaacccaaagtttcttcgttgaccctcctgggaaaccgggggttcttaccctagatgaatgagaactctgatgtagagcattcaccatgtgtgagccccatttgtgctgtgtggaccaacagaacagtcaagtgtacgaggtgattaataattgtgatggctgactctgatggggcgagggaatggcatatcctctagggtcctgtgctgaacaagatttagtattaaccactattgaaccttacctagagtgagcctgagtcccagtgttgctgacaacattggtagcctccccatcacagatgactcaagttttatttttcaatccatataactgtttccagatcatacctaagtacagtgggatttcttagcctctctcgcatttgacccttgtgggtgcagaagaataggggctcagatttacatgatagaacagttcttcagttccagtgttagattttctcttaaataaatgtgtaggtggaagggaatctaaagcctctttgatgctacccattctggttccctttatccagcatcttgatagaaaaatgcacagtgaagttacctccaattccttttaggttaggattttaaacaagaagatcgattttagcaaagttcagtccagatgtggttccaaggataacatcaaacattcggctgggggcggaaatgtaagtagaagcgccttttagaaagctgtcctgattgcgtggagccacctgcacagccagcaccctgccttctttcccacctctttccaacacactgctcctttctcactgctgttccacatgtctccctggtatgatagcttgtagccttgcattttcagtgatggacttcccatccttccctgtaagatcatcagggaatttcctgctttgatttgggaaagaaaaccttgatgggatgcaccatggttttctggagaatggcaaaaccacttcacttgccaactttgttgctggccttcttgtcttcaatgtattttctcacgttgtttctactccactacaaaagtcagctgggcacatatttttctagctccatttaaattacccatgaggcaaagactgatatacttgtaaatgcccaaagtatgtaatgtcaatcttcagtggttcattattcatgaaagtaaggatatcatttagaataatacaaaactggtggagcatggttcatttataattcaaagtgaaaggattcaagtccagtgtacactttagcttgatgggattttttttcctgtctctttcatttagtgtaaataatgtcctgtgagaggaagggaaagatgattccatgttttttaagtgtgattgaggcagaattgaaatggtcagacaatctcaagctaaaggaagcatggttctttataaaacaagaatagtttttcaaaggtgatcaggctaactgtattctacagatcctatctctttaaacttcagtttctgatcatccatgactcaagtaatttacagggtgtcgagtctagaatttcacctgtctactaactctttggctacttgcttcccaactgggcagaagtagaatcaagcagtgaagagagagagagagagagagagagaagcaagtgccttctacaagcagctgttgcctgataatcaaagtagcttcactgagcataaaactgtcattgtcattgaaagttcatagcaatgtttgctggcccccttcaggtatgctaggctaagcctcagggttaaactttacatttatgtggttgccactcttccttattccccagactgtaagtatacaccatgtggtactctcataaaaggagccccagtcctggtaattaccttgagggtatcagaggatggacccagctatcctttacacaagtgctgctggacaaaacacctaagtggaaaaggataaactaggataattaaagatcttaaagtaagtagaggagctttatctcccaaaacaatagtcttaaattttcctctaggaaagaatcccttgtttaaatatgcagacatcctggccctgtcctcatgatatctgattcagtaattcccaagtactctcgtgcagatgacaatggaccaaacttggagaagcactgcttcaaatattgggagaggaaatattttcagtaaaccacacagaagaaaaaaacctgttactatcattttataatttggtatgaaagaaaaatttcatctagctaagatatgacaatgtaataacaatttaggaaagcacattcagaacttcttgttgtatcttaacgttggtcttcttgtaactatgagcaacattggtcacttttatgtaaaaatcactttataaagaataatgcagctcttcccttggctctttgcttatggaaaggttaaacagtgttgcttagttctctgagtggaagcttgccttattaatatgtttctatcctcctgtgtcataatctgctttcaactaataaaatcttctattctagggttttctttcacttgggttcttctttccaatccaaacatgtgggagaatatatggaaaattatgtcttcctctgtttgtgtgtgtacttcaatttgggtttctagctatgttgttgcatgttgtgactttgggtgtgtttctagatcttatgtatgagcttgggtttttgtccatgtttgaactattttaagcatgttttatgtggttcacataggtacaaattgttaccaagaaaatagacctaagccatgtgacatccaaatgtggctctctgaagaacatccgccacaggccaggtaaataaataatttttagtagtttgagaaatatttaactggaatcaagaaagggatgagaaaattttttgttgttgcaaaatacctaattggaaggatgttttaaaatatgggtacttcacatttttattaatagaaactaaaattgaaaatttcaaggcatcttcattggggaaaagtgaacccaattacaatgaagaggacacattttaattaaaaattaaaaggtacataagacgcatttatctttatgtactcaacacgcttattggagctcctttgaaatacgtagtctataaaatacatcagatcatgtattcatatataataacattgggggtagcatttccaaggttttttttcctaaaattggctttctacattatgtaaaataaggattgtgctttgcaaagctgaagaagtgtatttatctggtgaatttctcagattctttattaggtcagtaaacaccatgaatacccagcagaatgcaatgtttcctcaacttatttgaccatgaaccccttttggtttttcaaaatatctcatacgactagtgccctaaagtagaatttatattcatagttactgggagattttctccctttaaagtgtgaatctaacattatgagtcactttttctgaatatcatgtattacatgtttttgttaaattctacctccatagagtgggcatgttggctcatgcctgtaatctcagcactttgggaatccaaggcaggaggattgcttaaggccaggaacttgagacagactcagcaacatagggaaacccctgtctcaataaaaaataaaaaaataaaaataagccgatatggtggtacatgcttgtagtcctagctactttggaggctgaggcaagaggatcacttagtttcaggagttagaggctgcagcaagctatgatcacaccactgcactccagcctaggcaacagagcaagaccttgtcacaaagaaaaaactctgcctccatagatatgtaataaaagatgactgtcatatttgtaattttcttgagaatattttgacacaattcatttatccctttgagaacaaaaggaaagcaaatggttttaactgtctgtgtttggcatcttaacatgaaaacaaagtaataggtttttttccatgaaacaaggtataataacaattgagctgttagctgacaattattctgctagtcaggagaaaattattaataaattattggttgaaaaacaaagataggtagaataaatttcaaaatggataaatgcattgaaaacatctggaaatcaggattcattttgtcaatgagtattcattataaagcaagtcaaagagttacaaactacatttatgatgtcttcacttacagtttcagaactgctgccatggaattagcttctctactattcatgacgcagcaggaaggttgtcccatacttcatatctttgaaattctcctgtccacagctgaagtctacaaacactaaattgactttgtactgctgtgtcaacagcatggctggaatacttggcaacactgcctattttctttcagaatgcaaaagaaaatgctggactcttcaattctagacagtaaggatatagttagtcaaactcacctgtgacctagatgtacggaaaaattttatatagataaggaactattctgtgtatgatttgttggtcataaaaggctgttgtcatggactcccacctatttctaaatctagctcttgcttctattataactgaatcaaatgactaaattcataaagaagtgtaagcataataatccttgacagcagcaaccttttcacaaagttactttggaatgtggaatatctaaagagaaaataaagaaaataaacatctggaggcacacactgaaatatctgttcttctcaacttcatttataaagcttgacaaagataatagtctttcacaattactgctcctgatgggtgccagaattcttcgaaaatcaaaggcatggatctctgagtttaagatatctggattctctaacagttgcataagaatttctagagggacttcatcagaaatagacttcttaagcttccttttctgaatatgttttgggtcaataatacattattatttttccctctcagaagacagttcatagtgagagtccatctctacaaaaaaattaagaataaaaataagctgagtgtggtagtgcacacctgtagtcctagctactcagagggctgaggagggaggatcacctgggcccaggaagtcaaggttgcagtgagctatgatcatgtcacttcactccatcctgggcaacagagcagaccttgtctccaaaaataaaaaggacattttagcaaaaatttaacacgattatattgacacaacatataatcagaaaagtaaatgatttctatcagaggctaccaaaaatacaaaaataagatcacaaagaagttgttcttatctagttgaaagtccagtatcctctaacctctaaccaagataagtctgtttttatgaatcattgcaaatcatgttcatctcatcacaatcaataagtgagacccatatggccaggtaaaatgtgggaagaataacactctataaaatgaggcatattttcagggaaggataactacatctctaagcatgagttaaataacatcatacagtttctaagccttaaaagaagaacgaatggatgtttctccaaaatgtaatctaattatgtaatataatttcaagaggcccctggccaggcagttgggtattaacatagatgtctagatattgcatgagaaaaatacctcatggcttaagagaccgtgaagccttaacaaaccttcctctttcgtctacagagatacatgagcaacaagaatccaaaattgcaaaatctctttcatatttccatacggtccatcaggcattttttcaaaatcaaactcccaagcaagatgcactttatgtactcaacatgtttattggagcagctttgaaatatgtagtctgtaagatacatcacaatcaacaagtgagacctacgttaccgcttctttccagaagaacgcatgtgctcaaaaccaagttgctgttaaagtgaaagcaaatctcttaggtggtgatgagcaaataaggagtccaatttcactttttatctagatcaaatacatcagcagacactcagaaatggtcaaggacaggctcaaggacaacgagtaacttgcccagtgtagaagaactttccatatttgagagcttgagaaagacgtgtagagatggggaagactacactgaagagtgcagcatggcactgttataatcagcagatcagagttctagactggttagcattagggaaaatggcatggtcaaaactctgtctcaatattatcagatcaaggtcagcgtcatattggtcctatggcatccatacaagaaagagatgatgatctgtcactccatatatgaaacgggaggcttttaaagcttactagtcataaacaacttacctcccgactcatttcatcagtgaagctttcaatgttgaacattcataaatgaatatattgcccacatgtgcaccacttccagcctaaatcttctttggataagtaacctgttaccatgaatataaagaagagtttcatttaaatttaatttggtcccttagaaataagagactaaatgttccaacttttagaaaggattcaaataagatattttcattttgctaatttttagagttcttgttataccaaaaagaaaagcccctctgatttcttaggttagacatgggtaaaggagaaaggtattaatacgtgaagcaatccatataatagtataagaagggtgttatggtcttgcatcatatgaggaaatgatatgggctagaaattctaaaagactctttttacatatatggttggagggatggtaaagttaataaatttgtggtttgccgtagtctatctactgcagtcatttttgggaaatagttaccacgaatgcaagatatagttaaatcaaggtatttcttccctcataggtggcggacgtgtgaaaattgagagtgtaaaactagatttcaaagaaaaggcccaagctaaagttggttctcttgataatgctcatcatgtacctggaggtggtaatgtcaaggtaagaaacaaggttatgagccaatcttgtctttttaaaaaaaattcttctgaaatactcttcatcaaaataggtcccagattgtagacctggacaaataagaagtggggataacagaggtgaatagaagtcattaatgtcagccctgggagatggagaaagaggtaggggccagttaagatgcatgagttaacgaggactgatgcttgtcttaaacagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 2410 - DNA, 204645 bp, Homo sapiens
ataatggttatatgctttttatttgtgacatttgaatacccaagctcacatataactgatttcctaaatatcatttaattttatgttgcttttctaattgatttaattgttagttttccttatagtcaaatgcttaatacaatcataaatggaaccaaaaatatagtaaacatttctttttctgatgtatgtaaaaaagatacaggaaaattctgaaatcagatcactataagctagtaaaacaggcgaattatttgattagaaatggactcttccttcataagttacacaaatccttatgtagtcactgaaaattcttactcagaattaatacctgtccagagggaaacagcctgttataaaagctttctgttaatatattttttaaggcaggaaaacaatcattatttccaaacacactttgtttgtctaattctaggagagaatcaccaatttcttcaaggtccaaaatgatcagaacaagaatgacaacagtgtcaaccaaatgatgcctccaactccttttaatgattgtgccttggtacacatttcctcaaagataatggctatacttttcccacaatctttttgcttttgttttctcccagtgtggtactcatggagtatggaagggacataaggtttagagaacataggaagcaatttgcttccatcaataaccagaatgatggattgacataaatcagcacaaaaagataagtgtaattctattcaagtcccttaatgttttgccaattaaggtttttttttttttttttttgaaacaacaacagtgtaatctttaacagggatgttaaaggtaagaagtcaggaagataaaccaaaatgattgagtatgataaagaattttgcatggcgattaaaatagaaaacctataaatgtagaaaaagcaggtctggacttagcaaagaaacaatatagtttggagaaggcatgaaataagttcttttcatgttcactgctggtcacagccataacagagagtgatgtggagagctttgggaaggtttcacgttgagttacatcagtggtcaacaatggagcaacaagactccgtagaggatgccaccctgggagaattgcaagggaaaggaggctgaagcacaactggtaatagccttcagatatttaatggatatgcaaataaagctctgattaattgtattttcacttattatatatcatctttggacctttctaaaagtgggacactagaaaagatatactgaaactcaaaaagaatacttcagctcgagttgaatggaattcaagatgttgtggagggttcagtgggttggttataccaaagaatgctatagaatttccatgcccgaagaactgtgagaggagtatagattttttcaccaaggaagttactggcatggtttgagagatagaaggaattgattaagaaacctctcaaagtttcttccacttaacctggctctgagactctgggtctttggaaatgagaaaatacccagggaagagaaaacgaacaatttaagaagcaggaaatgactctagatcagtatttctcaattacagccgtgtaagacattttcttcctaatcatctctcccttgcaccatcaccatgaaattttaataccacataaatactttgtatctgtttatgtacttgtgatcctttggagggtcacaactcactgtactatctaagagttttcccaaaaaaaccatctgacaattagggagtgtgtgctctctataaataaactatgggtccaaatgggaggtcattgaagacgggagaaaaaataaaagcgttgaatatttcacctctggctacagggagcatacaaatcctcacttgcccatgctctcacgtattgcctgcacatggaaacttccttcttcccctccctcctgttatatggaaagggatgaatgctttgctagtgctatatcatctgactgcaatgcttataatattttggggatcctgggcctccttgagaacattaagggatgaatgtacgtatgcacagcctcacactctataaatgtatgtgtcctgaatttcagagcttaataatgaattatggaacttgataatgattggatcaggcagacaacacctgatcagtcctaatatcagaaaagagacaagtagacattatgtgcttcctgaggtgaggcagtagtaaggaaacaacatcacacatgtagcagtcttgggaaaaaaaatgtaacctgtatctcgtaatgaggaaacaatcagtaaaaaagtctagattgtgggacattccacaaacttgcctgaactctttaataatgtcagtgtcatgaaagacacaccacacacacacacactgcacatcatacacaaacaccaccccaccacccaccactcagacacacacaaaagggcaactctaatcaattaaaggaaacaaaagagaatgacaactacatataacgtataattcttgattggatcctggatttaaaaataaacagctataaaggatattttggggacaactggagaattttgaatatggatcatatattagatttatgcagtatcagtgttcagtttcatgggcgtgaaaatattgcagatttataggacaatgctcttattaaaagaaagaatatgatgaagtattttacattttcatgatgtctgcaacttattttcagaaggttcaagaataagaatgtgtatttacagtgagaaagaaaatgtgaggcaggtgcggtggtacatgccatagtcctggctactcaggaggctaaggttgaagctcacttgaggcaaggggttcaaggccagcttgggtaaaatagggagagaccccttctcttaaaaaaaaaaaaggaagaaaagaaaacaaggcaaaacattaacaactgatgcactaaaggacataagggtactcactataatctttcaactttgaaacttttactttaaaatttcccaaaattaaaatgaaagcagaaaaagaaggagagtaggacaggttaggaagaagaaggagggttgtcagtctctgacccagagggctgaagctccatttataacagagatgaacagttagatgcagtcaagcagaggagataaaaattgactgcagagattttcttcagaatgtgccaaagttctgtgggaacaggaatattctgtgattaaaaaaaaaaaaagggtagtttgccagaatttaccctagaagagttcattagtgcaattaacaatataagcaggaggaaattcttccaagaagcttaaaaagatttggatttttaaattgagtggaaatttcatatgcacagttaataaaaaataaccttaaaaagaatgaataacaaaggtctccagattccagcctcctgctcgattatgcactgctgaaatgcaggaacatattcaactttttaatgtaaaaatcctgtggcgttccatgatgcacagctacagagttcctccagggcatgggctccgtagttacctctctgtgccactgtgctgcattcccatctggtaactgtgtattgcagaggctgggacttaggggctcttgtttctgttctctggatctctgtgatggtcagatattcttttggccaaaagagatgtagggaaaaaactttgcctatcttgtcctctcaaagttacttaggaagggggacaaaagtatgtttattgttgaccagggcacagcaacatggtgaggtagcagcaattggattccgtgagatgacctttacgagacacaaagcaaggttcaggctgcttggttaggtcaacagagaatgccactgtacccacagagacagccctttcttagcttggacaaagatttcatgattctagtcttttgtggcagccacagagggctttaacacattatgattgataaaacaaaatcagagtcatttagttattctttaatcattattactttaaaatacactaatacattcttatctacttccctccaccgacaaatattttgctaaattaaaaggatcactggaagtattatgacccccctcgtcacaggtggtcagaaccaccacagttttgtgaatgaatcagagaaggcaacatttcatcaacgaaaactcatttaggtttcaaaaggcaggatgtagtacagaatgcattattctgactgtcttctggaatagaaaaattggaaaggatgaaagaaggaagttagctccagctccactgttaccttggcaaccgtggcccaatcacaggggcagaaattaattttgtgccgtaacataacgtggcagaggagtggggagcgtggagtggggagagaatgacggctgggtttaaatgctcagaaggctagtggggagggttacaagtcagccgtctgggtgttaaatctacacgtaccaaataaccaattgtacttttttcactgaaatgttagtattatgtagagacagccacgactccctgtctttaataaagaacaaacactgcagtaatcatgcccaacgctcccgctgatcattcttagttatttaggacttttatttctctcttctgggaaacaggaaagaatatcttccactgaagagacaaggaatgatggtggttataaaaaatacattctgatcaggtgaactggtaacttgtcagctttacgctagtaaccagtctcttccctgcagttagaacgtgaagaccctgtttggggcagagacaagccaccccatggagtgtccctgataaaactatttattagggaaatgctatggacgcctcggcagggagagtagggaggtgcaggggatgggtaggggttcaggtgtctcagagctccacagccctgcacagtgttaaaccacagatcagagcaggagcttttagagacctgaaaggaaggcttattgcataaaaacttgctgcacatccagaggtccaaaattcacccggcacttaaaaaaccaatcacagagaagtcggccagctgacaagacagataagtggaaaaatacgaacacgcatctcagtctcaaaacctgaattccagtaaagcttaggcggcaggtcacaggcagaactgtgccatgtgtggaagtgcagaggcttcctcgtggacaattccccagccagaacggtcaaggggctggtccttctttcacgttgtggtctgcctcgtccacaggtctgggctagcagcactcagaaggttaagagcacacaaagtgagtggggaatgtctctcaggagtcactgcttgcctccacctctgctgttcctgggagtaggtgtgtcatttcagccagggtggtccacctcctgcccgctcagggcaccaggaggaaacagctttcctttcttccaaagggtgaggtggagcattagtgacacatcctgctcgtcatttctttctggaaagcaaggggaaaaggatggttaggagaaactataagcagagcaacgatttggtgaaggatcctgaaaatgctcttggaatctcgagagcctgtaaatgaaagcttgcaagcatggtccatgaataaggcttagcatgagggtatgttccatctgtttgttctgcagaattttttttttccattaaggcactgtttaaaaatttgactcatgtatcaaaattcaggttgcttgcttgctttttctgagaaattgcaagatttggagcttctgaacaactggagttgaagaatggctgtcctcttcagcagaagaatttgctctccagtttgccccagtccttgccactcccacctgacttcccagcaggagccatgtagcacttatgaactgatacagtaattggatttggactgctagttttcttcgagtagggaaagatttaagtttcaatcaaagatggaaaaataaaggataagtgggtataagtcaagaaaagcaggaaggaggacatttttaaaaatagaaatgaataatacaccaaagtgtctgacatgcgtcacctgcctggctcttgtgggtatttatagatcccgaatagccatcctttctctacccctggggctccgcacaggttgagtcccatgcctatggtccgctgctaccacatcctgcgcctgcccctcttcatttgtcaaattgccactcatttttccacctcaggtaaggtgacttttacctgctgggagaccttcccgcactcctgccccactcgctgtggaggtagccactctctcctcctgtgcacacattgattcttacatgcagtgtatgaatttgtacatctctgtgtgtgtgtgtgtgtactggggctctggacatgtctgttggccctgctagactgggcgctactaagtgccaggaaaaagaagcactcattgaatcgccccatgtgctttcatctttgtagcccctgcccctggcactgtgccagggtagtggctcctctttcatctccaaggatggtctgaggagcaggctagtaatgagccctgtgccatttagcatcttgagaagacaagtttcatgtcactttagttagatgaacgatcttccaagttctacctgctgcagagctgactgcagctactacatctcttgcatactgacctggactgccacaccttatataataggaaacatcgagaaaaaggagactgagtgtgggagtgccaaggtgttcagagaagcgttctattcgaaaaccatacagatgtgctggttaaagaaataacaatagacaaggcagaatctaggcacttttgcatctctataattattaatacaggaagttacaaatctatgtgtatatctaattttttcaatttttaattttttcgacaggatcttgctgttgcccaggctggagtgcagtggcaacagctcactgcagcctcaaccactcgggctcaagctatccacccacctcagactcctgagtagctgggactataggcacacaacaccacacctggctagtttttaagtttgttgtatagacaggatttcaccatgttgccctggttggtctcagactcctgagctcaagcattacccatcttggcctcccaaagtgctgggattacaggtgtgaaccactgcacccagcttttggcttaactcttgatgacacagacaaggaaaacaagatgggaatacaacaagagcatgtgtgtgtgtgtttgagagagacagaaagagaagtagggagagagaaagtgtgttcatgggataaacagaattttagctttataacttaattatttgcaataggtctgtacttttgaaaagaaagaagctagctatagttaaatatctataagatgccaggtgctttggggtggttataccattgcatctgtataactctaagacagggaactatgacctccaatggacagaggaagaatcccagtttcagagcagaagctatttgctcaaggtaaatgggtaaggtacagaatgctcaacagtaaccgctgcttttattaaacagaggcctgctgtttgccagtcccagtgtctactgctatacagatattatactttgtgaagtaagatttgccatctctactgtattgatgaggaaaaaccctcagggaaggagagtaccttaccaggtcacatagaaagctgcaggtctacggtttaaactcaggtctatctgaccgcaaaggcttgctctttctactacaccatgtgattgtaggttaaagcctctaagatagtcttatgaatatgcaatcggataatactggcatatattaattgacatatataattataggtggttgcagtcattcatgaattttcaaaatgccagatttttttctttatccagactgatgccagtttgaattataggtacaatgggcaaatactagaacaattatgccactgagagagtatggacactagaaatatggcagagtttttttttaagtagcagagtaacagtttcagagaggacagggtacttattcaaggtcactgagatgcaggataaaaactgtttcctgggatgcctcttaaattcataaagggaatgtatggttgaaatagcagatcagaaacatcaggaaagacatttgagttggatccatccttcaaagctctgcaagactctgcaagctgtattctagcacttgcccactgggtggagccaatgagctgttaaaaaaaaaaactcgtttaaataaacaaatggcaatgctaggttccatcgctttcttcatcagagccctcccgcaggctagcagggccaaacacattccttcctctctgagagtgtggccaaaatagcttctacccagggtgctctttacaatgaatttgccattgctggagttactgaatgccctgtgtattaaggcaggccactaaagaactccaaaacgtgtattaaaaggcttccgctgaggtgatgagaagcttctgagaaagttcctggtgactgtgcttggcttgtatatgaagattttcaaaaacacctgaatttttcaaaatgtgtttttaacagaagatcaaagtagaatcttggttgtggtcactcggtttcatttgttttaaaataaagcagtaattgattctatgaagtccctggttctccactgtcaacaaaacaaattccatcctctgaagcctgtcaaagaaagaggacccatcgccccctgctcacctcctgctgaattccctcccactcaccacaccagccaggcaaactagacttctccaggtctccaactggccagtttctagtggtttctttcttatatctggtaaatattttctgcccttctctgcctggcaaattttgacatcctttaagatgcaattgtcagctcctttcttgggtatctccatcactttgcacacatttgcattctatcacattggaattcatcatttcatttttgcctgaatctgagaagaacattaatattttttagtatattaatgtatgatgcatattttattcaaattgtataacaggatgtatggtttgatccagttattttgagaaaaaatataaagaaaaatatgggtccaacatgataaatttatctttgggtgaatacaattgtgtatgttttctgtttctaatttttttgtcctttgcggagtctgaagttttagatatttttgatatgcatgaatttttttctaagaaaacaagaccggttatttaaaaaacaaaaaggaaagtagacagagactccaatctgaaatcatatttcactttagaaatgaagttaaaatgacatttgcctagtttttgtggggacggtgggggtggatgaaatcagcctgtcttttacataagatactcaattttttctgttctgatctaaacactttttaaatttaaatcttctttatgtacttgttagcagttggaagaagttcttgatagccattgaacaaacttccgtgaactctaagtgtcaaatcttagtctaacctcagtgtacccatttttataactggtagtcagtggaggatagggaataatgatccagagaagtaaaatgacttattccaagtcacacaaatactctctgacttaggcaagactacaaagaaatcaacgctctcagtttactgcactacatcatcacacattttagtaatctaatattcttttttttctttttctttttgagatggagtctcgctttgttcccccaggctggagcgcagtggcgcgatctcggctcactgcaagctccacctcctggggtcacgccattctccagcctcagcctcctgagtagctgggactacagatgcccgccaccacgcccggctaattttttgtatttttagtagttagccaggatggtctcgatctcctgacctcgtgatccgcctgccttggcctcccaaattgctgggattataggcatgagccactgcgcctggcccaagaagctaattttcatatggaacatatgaagaagaacacttgatgtttactaggggacagtcatcatgcttgcacagcaattttaataagttaactctaggaattatgaaacaagcgccaaaaagcagtgacatcatcacagagtcataggctgctgttatagctgggaggaaacatgggtgtcacctactccaacactttaatttcggagatgtggcaactcagaccatcggaaagtaagtgacttccctaatgcggcaaaactaattagtggcagaactggactgctggcctgtgggctctctgacttcacattgattcgaaagaggcaatttgtgtacacaggatttcttagagctggcttgatgtgctgcaggtaaaatctttatcatctcatgatgctcctaaactccattaatggctttcagtagttttcaaaccaagtctccactgtaacatacgatgctgttcctgatctagactcttctcaggcactcaacctcatcccccatcggtggccgacgctccttctctcccatggaacacacaacgatttccatacacatgctcctctcttcccagaacacccttctcccatcgccaacaccctttaacgctcttgaccagttgtcatctccttagggacacattcttctaccctcccaccctgtccccaaggaatcctaggtgctcctcttccagattccctcagtgcccatgacacctttcacactgttgtgcgaccgtttatcacattcctggtttcagcaccaggctgctcttgaagagagaaaacctatctggtatttgtgtagaccctggtgctcaagacctggcacatactaggtgcttaaaacatattaaattaaactgaaatccaatgaaaaggaacacttattaggtctacagacccaagtaaaatgagaggtggaaggaaacacgcatttcatacctacgatggggaaggcacttagacttaccttgtgcactttctcacaactctatgaactaggcattactttttctaatttacagatgaggaaaaggaggcccagaaatttgaactaacttgcccaagttcacccagctagtcagtgtaacaataatgatttagtggactcaaaaacaaaaacaagcaaacaacattctgctttcattactctgctggagggaggagcaaaagaaaaggagtgagtctttttgtttctgttgtaaaatggataaggggggggaagagctaccacagcagcatttcaaaacccatgtcttcttttaattaccagcttcctgctaactctgagacaccaggagaaagggggaggaagaaatacttgaaacaaaaaataatcaaggaagaaaagcagtatgaagagatgtagaaggctccgcagtgtggtaaggagcaggaggacccttggtgctggaaactttggaaaaatgactgttatatacgtgaactcctgcccctagtaaccaccattaaacagccaacgggttaaagcagggcagtgagcagtacgcctctctcagggccacatctgacattatgttgtgtacttctcactaaccattttaaagccgttggatgtttaatggtggctactagggggaggagttcacgtatataaaggaaattgggctctctaatacagcacgcccgcacacgtgtatactcatgcgtacacacccctgaagtaatggaaacagaacggaaagtaggagagattcatctcccccagcaccttttccaatcatgcagcttcatcaatacattttaaaggtaaaatcaaatgtgatattgctgaaaagacacgaggaaagctgcgagtcccccggaaaaggccgtcaaagggtattgcacgtttcacaaagtgcctccctgcccattaatcagcagtgcagcctcagtcccagctaccggccccgtgcccgagcttggccctgtggcctgccgtcagccccatctccactcagatgggacatacctggaaaagtggcttgaactgcagcagaagtacagaagccacatttctggctgggctgggggtggacagcaccaaaaccctacaaccgggaagagtttcattccccacagcaaggctaaggccctctaggggtagaggccaggtcagaaagagggctttctggaagcctttcgtctcacaaattccacttcttagagacttaaaaatctccagattgtacccatatttcattagtttcttctgtgatggctgtggattgagaacactgaccatcttgaaaattccctctctcatggctttcccctgcccttcctgcctccattccaaacagctgtgctggcgaggtctatgccaaggtttcacggccccctcccaacagggtcctcagctcctgccagcactcacttccctcaggccacatttccacactcaatgttacaccaacattttgctatttccttatctcaagatctaacccacttatagcaaaagcaagtccctctggactgggtagttttcttggaggagtgatgaggatgagaccaaagaaaatgagctggcatcagcaagggattcgggttctcagctataccgtgtgggcccatttgaaatcctcttggactgtagacagggacagcaatcagtgaggtttcttctagtgtcgtggcgctatgagaggcatggtgatactgttgtcaaaagaatcccaaggcaagggcaggtgtgctttcaggggctgtggaatcaaaagaggcagtggtattgtggtaaggcattcaatgatcaaaatgaaaaccaactgttctctctgaatcgtccagtttgaagggctcagaattccctgtggcaccatgctgcctgtggtcctagaggtaacagccacatgattccagtatgcaccaaggcccagaagcaccactctctaatgcctgctggtgtcctcaacagcactggctggaaaggtactgctgaagatccagggagaaataaaactgttttcctgcatctccatttcctactagatcaagtcctcaacttcccatgacttgcaaggacttctggatctgcttcccgcccctgtctgtggccttgcatacaccttgcttctgtttatcttgcatctttgcacacttgttccttctgcatggagagccctatttccttgtttcctccagagcactccagttcctctttcccagccctgcttgggtgtgggtgaagcttacaagccacgtaggtgggagacagagcaattcccagaaagggagcagaactctgggtgtgatgaaagagagatagaggatcccagcagcgccccagagctggttgctaagaatttgccctggcagctggctctccttcagacgggggtgcagttctgctttgaaggtgagtgtctgacttcaaggaagacccatgaaaaacatcaggctgcttgctgcagggaaatccccggaaaaagagaggagagaaaaaaagaaaagaaaaacaaacaagcaaatacaaaacatcccaaacaactctacagccaagtccatgtggcaaagcgggaaccgtagaaggtgggaacaacagcagggcagctcttgcctggcctcgggcacagggaggccactgtgtcgctgtcgggaccacagctgtccaaacgaggctggctccccacttcctgtggtgtttctcttttagctttctagaatccaaatagctgtatgtatcagaggaaataacactggccttttcccaaatgccttggcaactccaggggaaggacccctcccaccccgactccggtggacaggcaggtaactccacaagtggggcctcctggggcatgactttctaaggagccctcagttgcatccttggtgcagagtgagggtgagtccagggctgcttaatctgctttcccggaccattcccagctgtttgtgtgaggctgtggagggagtgctgcaagttagggatccctgggaaccctcggggagagtctccctgccatgcactccccctaggctcaggggacttcgttcttgccctcaaggccttttctgcagtggtcaagctggtggagcttcctgcctggaagcttgttttcagaggagggtaaagggaccaggagtcaatggtggaatccttaggcgaggttcaggcatgaggcctaaacatttttttaggaactatttttttgtaacgttgttgtgtctgtttcagagcatctgggagagagaattccagtaggggctgacatcagccaccccaaatttattttggaactaggctttattggtataaataacttgagaagtgaacgaatgaatgaatgaagccgtgccaggtcacaagagtcagagtgaacaagatggggcagtgataagagagccatcattaaccaaagtgtcttgtgttccgaatggagtagtttctatcatttcctgcaccttttctgtgtgccaggcactgtgctcaatgctggacatcatttcattcaatccttacatcagtcttatggggtatgtggtatcattcttattttacagaggggtaatggaggttaagtacctcggccatggccacatcactaataattaccctggccaaggttgaaacttgaaaacccatcctcctaaccagtctactatatcctgagccatcgtgctgaatatatcttcattcatatctacatgtgctgtttcagttgagtctctgaatcagcggctgtaccacaccagcatgggccacgggagtagggactcggctggcaggaccgttcccaggaggcccacagccagggctgctgttcttcctttgctagcatcccaaagtctgaattcttataaagcaggcagggcagccagtctacaaaaatatttttaaaatttccccaactctaagtatatacaggatccaaccagcacacaggaattagaaatgttctttctgctctcttttaggaatgtgggtggcaaataagccaaacgaaataaaaatagaaacaaggcaggccagacttccctaaaccacacagaacaatatttatttgattaattctgttcctaaacaacagcccacattactgacacggagggcgtttccacgatggaggggtgcgtgtgtgtgaatgtgtgcacatatgtgcaggctcccaagtgcacatatacatatgtatggctagataaacacacacactcgccacccacggagaatatttattcataccgatacaaaaatcaaactgctcttctttttccaaaccctgcaaacattaaaaataagtcactttatgtaaacatattcagcctcctgatttacattgtttcttataaagacagagctgcacatttttgaagttctctcatttaaccacaggagatgggttacggacacatggtgggttgcctcatagtgcatcgtgaaagcaagagcattaatcaaaactgtttgtggtcactgtatctctgcagatcccctccctagagccccgcagcccacccctcattctgcaactctgtgctttttttttagcaccctgtcttgctctgtggatccacctaccatgtccttcccacctgtatcaacctggctgatgcactgatgggacaggggatccaacctgatttctgctcagactgatgctacctgtgatcaaaggagcctgtgatttctgctcaaagcgacactgagatctctgacatttggctgctgctccccgctcctttcctcctctgttacccaacttctccagagcccccatggaggtctgcacagttggcaggagtctgcctccctccttctcatacccagcatttgtcagcgcagctggattggtttctggcagatgctgctgctgccccttgttctgggatgagcaaagggtgactgagtgcacccacccgctttgaggaatgaaacagatttcagcatggcccaatgccccctgtagggttgtgcagttccttaaaggctggatgcgggagggcaggggaaggaattctcacatttgcttctgtcatgtggcctttctatcaggagtgggagggaaggcactggccggtgaagcagagagtaccggaaactccaggttaggttgcaggcaccagagttttatttattctgacagaagcttaatgggggcaactcttaatgacatgcaagaaacgctgaacaaacggtttgtccttttggagggagtattctgaactttcagagcatgggtccctaaaggaagaatttacctcccctgggaaaacaaaggattccatagaagccgttcagcctagctgaattcaccacaggacagagcttgccattgcttaataagacctctattgtgtgtctgatgaaaacatatggggaatgtgcttcctcagtgagcctgtaatttaggaagtctgtagtttctaagcagtctcactcctttggtaggaacaaagtgttattttgatggagtaaatagacatgaaacaaaactaaaattttccttttaatacaatgagatctcttgctagaagtttgactaccacctattgaaacatgttctcaagctctcacagagagaaatttggtctcgtgagagcctcaggagctggtcaccactttgtgcccgactctgtcactgactctcaggtctatggggtggccattatgcttcccctagagaggaactgaaacttggaaaggttagtgacttgcccaaggttacatggttgatacttggcagagcgagaattcaaaccaggatatcatttggatcttatcaacaggcctcggaatcctatctttttttctatatcagggaccagaaaatgacagttcatgggtcaaatccagtccacacctgtttttgtatggcccataagctaagagtggtttttacattttttgatagttgaaaaaagaaagaatattttatgacatatgattattttatgaaattcaaatttccatgtccataaacaagttttattggagtaagccacacccatttatggatgaatgcctgtggctgcttctgcacttccatggcagagctgagcgactgggacagagcccggcatttagcatgggggtcttttcagaaaagctggctgacctcgcgtcgcaccatgccaataccatgaccagtgagactctctagttttgacccacatggttataaatggatccccaagctgcctttccaaaactgacctggcaataaatagtccaatatttatttaatctataaatagtccagtcttctgtcttgggagaacaatgatgttacatcagtagaaaaacgcttctaaaacaagagtggagtgaactctacatgcctatagtcccttagaactaaacccctctccctccccctccccctccgtctccctttccctcgtctccctctccctctccccggtctccctctgatgccaccaaagttgtgaaagccaaggctggactgtactgccgccatcttggctcaccgcaacctccctgcctgattctcctgcctcagcctgcagagtgcctgggattgcaggcgcgcgccgccacacctgactggtttttgcattttttggtggagacggggtttcgccttgttggccgggctggtctccagctcctgaccacgagtgatctgcctgcctcggcctcccgaggtgccgggattgcagatggagtctcgctcactcagtgctcaatgttgcccaggctggagtgcagtggcctgatctccgctcgctacaacctccacctcccagccgcctgccttggcctcccaaagtgccgagattgcagcctctgcccggccgccaccccgtctgggaagtgaggagcgtctctgcctggccacccatcgtctgggaagtgaggagcccctctgcccggccgccaccccgtctgggaggtatacccaacagctcattgagaacgggccatgatgacgatggtggttttgtagaatagaaaagggggaaatgtggggaaaagagatcagattgttactgtgtcggtgtagaaagaagtagacatgggagactccattttgttctgtactaagaaaaagtcttctgccttgggatgctgttaatctataactttacccccaaccccgtgctctctgaaacatgtgctgtgtccactcagggttaaatggattaagggtggtgcaagatgtgctttgttaaacagatgcttgaaagcagcatgctccttaagagtcatcaccactccctaatctcaagtacccagggacacaaacactgcggaaggccgcggggtcctctgtctaggaaaaccagagacccttgttcacatgtttatctgctgaccttccctccactattgtcctatgaccctgccaaatccccctctccgagaaacacccaagaatgctcaataaatactaaaaaaaaaaaaaaaaaaaaaagaactaaacctctttggctttcagagtatgagaggagacaagtccttttctttccttattctcagactcccagtgaatgatccatgaaaacaatatgaattttacatacaggaaatgtacttaataaggcaaaagcatttttactgttagggctccttcctcacctgttcgtcttttattatgaggctggaattttagcctttttttttttttttttttagcagtacagggcattttatgctactgttgttacactgcggtttgctctcaatataagagggaaattgtggaatgcattgaaaattggtagcagcactggttcagttcaagagaaataaagcaagatatccttttacttcacgtaatttttgttccccatcctggcctcacttgcaaatcctaaagacccaattcatatgtgaagaaacaacaacaaaaacaaaagccataggtaccaagatacagagtttgaagctagatagatgatggtaatggttgcatgacaatgtgagtgcatttaatgccactgaactgtacacttaaaaatagttaagacactaaatttccttatgtgtattttaccacaattaaaaaaatttagaaaggaaaaaaaaaacatagctatccattttagaaaaaaaattcaaaagcttcaaggaagaagatttttacacataaggccattagtgaaacgaaacaaaaatcctcataggagttttgaaagatttgaggctttatggggacaaatgagcattagtgcatgttcatgtgggtgcttgtgtgtgtaatgtgtctccaagaaaacatccatgcccaactaattcagttccctctgttattgctgtcagtattagaaaaatgagaattattccatttagaataatctccttcttttaatgcaaaatgccaagtaccgttgcactagcaacaaaaaacaaaatagagtaactatgtctgagaacctattataactccgacatcttacaccagtgacaccaaagggaaaaaacacacccactgagcacctatgaagattcctctgcagtatacgtacaaaggctgtcgtagccgtcagggaaagagtgagttccagagaaagaggaaaccacaatagaaaccttgaattaaaaatggaatttagatatgggcaagagtgccaaccttaatgaaaagtcttcttcttcaatcattaggctgtaaaattaaagctggatgtggatgtggtctaatgtctactttgattcttgtgtatttgccaatgctctccaaaggtgaataagatgaaatcccttctggatgtgctgtgagcactctggtcctttccaccagtttcccagagcataggtgccccacagtgcggtttctgaaggctctactgtttggaataggcacatacaataacaaagctgcttacagtctcggcctggccgcgacagggtcaacaacctaaatgccaactggcgatgacactggtcgtgtcaagtgaagccaatgacaaaggaacagccatgctctgtctcttggtgcccacagcaatacagtcactgtaggccagcaatggtgatccagtatgcagcagcatggggtgaagctgacatcaacccaataaatgaccactgtcttgtcgtcttcactgaaatggtgcatatgcctcccccaagcccacacacaaacactttgcttcatatgcttgaaagttgtgggctttcaggacaagggaaaactaaaaattgctctctaaatgtgggcactgtggatgtgttgccaggttgtaatgggtcagaactgctcctgcccaccataggccctgtatgaaccatgactgcaaacagatgatccctaagcaaactgtactcccagaaggggtttttaaaaaatctacagatttttaaatctgtagatttaaaaataaaataaaatacaagtactgctctaagtagttgccatcatttaaaactctggagaattcacctaaaatgctagagttccaaattcttctgatttggaagcactgggcctctatgcccgccctgaaactattagttgagttgcatggtggttgcccccacagcttcctatttcatgctactcgcctgttaactgatatttgttacctgcctgactctgttgactttggctttggatcttctgatccatagtcatcaaactccttgagggcagtagtcatatctcttgagctacagcagcacctaggattggctccttactcctgtttcacctgagtcgctcaactatgtgcactatgtgtatttcatgggctcaggtatctaaagtgacttgactgtggtcccacagcacacactgctgagacagggagagaactgggctcgtggagctggaggcccttggaaattatctagctgctgcagatcatcagaatctagttgagtaagtaagcctttgggcaaaaatccacctcaaattagtttcctcagcaaataccatgctataatttgaatgttggtgtcttccaaaattcatgctggaacctaatgcccagtgtaatagtattaagaggtggggccttttgggaagtgactaagtgatgaggatccaccctcatgaatgggattagtgtccttataaaagagacctgatggggggcttccttgcccttctgccatgtgagaatgcagtgagaaggcaccatctttcaggcagagagcaaacccttattggataccaaacccttattggatactagcaccttgatgtaggacttcccagcctccagaactgtgagcagtgcatttctgttgtttataaattacccagccagaggcattgtgttatagcagcccgaatggtctaggaaaggctgtatctgggttttggaatcagaccgtatgtgctcaatcttggctccacagagctgtgtgacattggacaagttatttcacctctgcatctgattttcttcctttttataatgaagataaacagtatttatctcatagacttgtgtgcagattgaatgacgtaacacataaacacatttcctacagcacttggctcatagttttacttaaaagtcttccctattattatatcctctgaagctgaacaaatcaaatgaaaaaatatatatagttattacaggccatttaaagttcttctatatgaaaatattttaataagacgtggacataaatctctaccattaatctctattttaaaattataccattagaggccgggtgcggtggctcatgcctataatcccagcactttgggaggtcgaggtggatggatcacttgaggtcagaagttcaagaccagcctggccaacatggtgaaaccctgtctctactaaaaatacaaaaaattagccagttgtggtggcacgcacctgtagtcccagctactcgggagtctgaggtgggagaattgcttgaacccaggaggtggaggttgcagtgagccaagatcatgccactgcactccagcctgggtaacagagcaagactctatctcaaaataaaataaaataaacagaattatactattagaaataaacaaagtaaaaggaaaggcagtgacaatctatgttattctggatccacaacatgccagaactggagggaatctaaacctatcctaatggatttaaaacttattttagcagcagaaaccatttcttttaatgtggtcttacatacatgccattcacgagagagatgttgcagctcaggttaggtgaagtccctgaactaggttccagcttcacccagcaaattatagaacctgtgtgctaagggccacagtttggtaactgctgatcttggctatgcctttttatttttaccagtgggaaaagtaagacctttcatatgcctgcacatagaagcaggctcacactgaggaccaagcctggcctatcactgtatcctcagcacccagccatgttcctggaacgtagcgccctggtgatactggggtttgcataatgggtgccatagcacaggtgaggtgccaggcttctgaagtgcagtcttgggggatggacttctagggtagggtggtgatcgctgccagcagggggtaacaaaaacaccattaggtctagccaaggtgttgcgtgtaggatggattctgggagaaggtatagggtggaggtaagcaagtataagcttactgacttacccagagcaactgccagtcctacaagctccattcatggcaaatgccctaggcaggtgtaccattttttatctttcacactgtatttttactgtactgtttctacatttagatacacaaatacttaccattatgttacagttgcctacagtattcattatagtaacatgctgtacaggtttatagcctaggagcaataggctataccacatagcctaggtgtgtagtagctacaccatctatttttatgtaagtatactctatgatcttcacattatggcaaagttgcctaaagacacatttctcagaatgtattcccatcattatgtgacacatgactgtacttctgtagaaagaccaggtttctggagtggtggagtggtggagggcaagttactgtgaattgaaagggaagtgagaaagtgtagatagttggctagactggcttctttcaaggaaggggaggaagaagaaaccacactgaggtaataggagttttcacggagtcagatttcttaagcaatgagcactttggagaggtagcagacttgtgctgtaggatgtagaaaatgggaaaagaaagagaaatgcagaggtcaaagaaaaacatcaccagtttaaaaatgttggtctctgtggtggtttaaaaatattttaaaattatttaacatatgaagaattatttaacatttctctcttcaagaaatatggccaggcctggtggctcacacctgtaatcccagcactttgggaggctgaggcaggaggatcacttgagttcaggagttccagaccagcctggccaacatggtgaaaccccatctctactaaaaataaaaaaattatccgggcatagtagcatgcacctctcattccagctgctctggaggctgaggcaggagaatcgcttgaaccagggaggtggaggttgcagtgagccgagatcatgccactgcactccagtgtgggtgacagagcaagactccatctcaaaataaaaaaaaaaaaagaaagaaagaaatagaccttaattttcctttagtgtgggctggacttagtaacctacttctaatgaatggaaagtgggaagaaggttgggttatcacttctgactctagtctgtagaagatacatggtgatttccatcttggttgccctctctgatatcagggcattctgggagtagccagcagaaacctaacgtttcaaatgaaaggtgtttgtctctgagaagcggacaattaggcctagacttgcaggatgagcaggacttaagctgaggacatggaagccaaaggagttgtacatacaatggcctgggggtgagaggacatggcccattcaaagaactctgggaagttccctatggagctatctgcatatctctttcttcttccagatctgcctccaggcattattcttgtctattggtccatttacacttagatgcacaatgtaataggactctattagcaccaacatcttggaattaatactaattagtattatgttccagtaccacattatagcttaactggctttgctggtggtttgtatatctgacctttatgtataaaattgtttcataggaggaagtgctcctgagaccacacaagtgaccacacaagtccctaggctaggtactgcctgtaacctgccttatcttcatgcctttattgtggtgggacaggtgggtggtgggagaaaatataatgttatgtttcaataaataaaaccttccttcattcaaaccccaagttaatactcgcttgacatttttggagccaaagaatctaatcttatctggccgggaaatttaaactagtctagaccacacatagcagccaaaatttggcaggcttatatatgggcatcaagccatactgactatttacattttcatgtaaatgctcatgaagacgaattaatccctgctgtgactgacatcctgcagcaatttccaacactgcagagaacattaaaaaaataaaaaagtacaattactatttggtgtctctgaccaacagctcccctaagatactgagcagcttcctgaggtggaggttctgatgggaaatctagggagaaatgttgagcagaaggtactgagttttatttattcctatcaataaagtaggagagaagtggcttagcaaagagaagcaaccatactagggggcttaaacaatgaacggaaatgcctcatgtggcagcatggagacaatgtgaacacatctggcagctctttgtggagggagtggttgttaagagtgggttataaaaagtagctcttgaaggtagagcctctggctcagtggtgtctgagagaatgtcccacaatgatgaaaatgttcagtatctgtgatatccaatacaatagccactagacatgtggcttttgagcacttaacatgtggctagtaaggctaagaaactaatttttaatttaatgttaatctcagtagtcacaagtggttggaaaagccttttcaagtataaagtttgatttttctgattagaaaagtgacacatgtttgtgacagaaaacttagaaagccccaaaaagtatataccaaaaaaaaaaaaaaaaaagcattatctatagtaataccaagagagaaccactgttggcactttttgctctatttcctttatcatctgtggacatatgattagtgattttccagtacagttttgtatcctgcttttattacttaatattatatgctagcaattttcccatgagagacatcttcaactataattgatcatattttaggccctgaaacaaatcagaccacatctcatctctgaccaaattagaaacaaagagaaaccctaaaacaaaaatgaaccacccaacaccctataaactagaagcaaaagttctctggacatcaacaagggatgaataaataggactggcagagacatgtggctatttttgccacatccccagttacccagcataaggcaattcattggaaataatcatgtttctttgctatttttccaattgacactttagaatacatctgccaagtctcctaaaatgatatctggcaggccctcccactaatctctgagcctttgcattatcctgaacaaccaccaacagccgatgccaccctggacacacatatacttgtcatctgaactggcaaagccccatgaatgcacactccagctactcttggcaacatgtacaccccctctgcccctctgctgccatggtgggctttttttttttttttttttaagacgaagtctcgctgttgtgccccaggctggagtgtgatggcacgatctcggctcactgcaacctccgcctcctgggttcaagcaattctcctgcctcagcctcctgagtagctgggattatgggcacctgacaccacgcctggctaatttttgtatttttagtagagatggggtttcaccattttggccaggctggtctggaactcctgacctcaggtgatccacccgcctaggcctcccaaagtgttgggattacaggcgtgagccaccacgcctggcccacagtgggctttaatccatgaagggctctctaagcaaagagaaacggttgtcttggatgaaagatgacagggctgctgacacatcatatcagtagtaatcccagtaggtcagtaatcttagtagtgacccatcagtaatctctgtaggtcaggctgggaggattctagggatgatgtcttttacaggtggggaaactgaggctcagagccattacatgccttgccccatgtggtaactaatgtggtagcataatagtggaaatgccattgtaaaggccaaactgtcagcttcacaggctgcagctctttcttctataatggctgagtccacatcaagccttctggctgaaggccaaggaagccgcctgacaagaagcaacccagaggcctctgtacagatgatgtttcaaaagaaaaggtcctttcaaaagccccacaatggctcttcattgctggctactttagggagtagctctggctcatgcgagaggttctgcttcttttcacagtcctgacttgatcttaccattgcaggccaaccttggctgctgcactcacccaagcaactctgagagaagtgtatgtgtggcctggctacctcttagggcaacatgaggtcagtgtattctggggcctggataggcttgtggctgggcctttatgagacaaggctttccaaatctttggtcttcaaattgttctaaaaagcacccgtttttagaggatagttttggtggtagagcctaccataaatctcaatcattagccaagaggcacctacacactgggggtgggacatgcactttggtgtgacaaaatggcagtgataagggatggagaggaatgtggttcagatgttgagaaactgcccatcacatctgctggaaataatagtaacaagtctggccaggtaccatctgtaatcccagcactttgggaggtcaaggcagaaggatcacttgagctcaggagttccagaccagcctgggaaacgtagtgagaccctgtctctacaaaaaatttaaaaattagccaggtgtggtgacatgtgtttgtagccccagctacttaggaggctgaggtgggaggatcacttgagcccaggaggctagaggatgcagtgagccatgatcacaccagcctgggtgacagagtgagaccctgtctcaaaaaaaaaaaaaaaaaaaagtaacaagtgtgaggagatgaaataatatatgtcaagaggaactaacagattatctggaactgaagaaatgaagttattaattatttcttgaaaatgcttgtgcgtcatgcacatggtaagaattccacgaaggggtgtctgtcatatgatgatgtgggaggatgaggagcaacaatgaaaaggactgcacttcctgtgtgtgtgtgaagccctcccatatggagtttcacttccttcccacctccctctccatgcggcagtggtggctgtgtggtttgaggccagggtggaggcatgaggaaaatagaaaaatctagagacacatcacatcacaaagatgagcagtgctgcccagagtgtgttccatggatcatgatatctctaagatgtcaatgagtgatagcaaaagaaaaaagtccagtagccaaatgcagttaaattgggcgggctacacaaaattgaacaagtttctttactggataccttctcaaaggctttgatatgctattgtacactgtaaatcttcaagggtggagacgatgtagtattttgtaaactcatttgaccacagaaggaagtctgttttcactgaccatcactcaggactggcattttgaggagctctcttggcaaacactgatcttcagatttttctcctttttgctttacttccccaccccactgagctaactcccaatcctagaggagaagagatgaagtgctaaaaatggtaattctcacatttgagggtaattgtcatctagggtcttttccctcaacgtgtggtctgggaaccagcagcatcgatatcatctgggagcaaaatgaacattctcgagtctcctcctctcagatgtactgaatcagaacttgcatttcagcaagatccctggtgattcacatgcacattaaagtttgagatgcagactgagggtgcttggtactaggcactaatcttaataattctgatttagtgtatctggggtgaggcccaagaatgtacttatgaagtacttcctccaggagattctgatgcacgtgtgtgtgtgtggactcctgagaaacccctatggtccaagcaccctgctataaggtaacagaacagctctgtggtaacattggttttcacagcagcagctctacaaggtaggtggtggtataatcactttcattgttagaaacaagaaaatggagccttggagagagaatgagaaggtcctggaccaaggtcacccaggggttagcaggtgcattagggtaaacaagtcccctcctgtctgtcctccccacctcacgaatctctgtcctccccctgccctaatcagctcttcattcacaactactgcattgctaacagccctctctgagtctgcttttgttttcagtgaaaggccaacaaaacactgcgggctattcgtgcttgctaatgataattctgattagcttaattgtgtcagctgactccctggcagccaagggccaacagcagcctgcttattcaatcagggcctggcccattttctaattatcagcatcatttgggctgtttcctccaacaaggaacttgcttcagttcaagttatcttcagctgttgcatttacatgagcaatggatgatctgtcacgtctgtgtctgtgtcagtgtgccaggctccccctccctgctggagaccaagtgaaatggcatgtgtttgcctgggttcccaggctgccagccatagcggctgaacagcaggtcccaatgggagccatgaggcaagctctgggggtggatggatgtgctggtcttcaccaggctagccagggtgacctcttcccagcttctgaattccaaactgtattcccactcagaggcctgatagggtgaccaaccgtcctagtttgacagacaccaagagttttcctaggacatgagaatttcactgctaaaacagagagggttggttatcctttgcctgacacaccagggcacaaaagcagtgtgagaggattcaagatttcctgggtgatctatctggaatttggaacagagaatgactaagagttgaggcctcgtctttctctgtgagacctaaagcttatgatgcatccctgctctctgtcttattttgcttttaatgtctattgctaatctgacaggatgaagcattagtcccaacatggaaatgggtaagtggaggtctgcatgcatgttctgagataaggggcgtattgaagagagtgaccagtgtgtaatccctttgaatggaggtgcatcatccttaaagtactctccccaattcaaaaacatattaagcatttattaggtaccaggaaccctaagcaatgcaggaatatgtcctttatattcccagccctcaaagagttgacaatcccatgggagtgactgatacaaatacaattaactacatttgctaggagtctacctagggaatcaatcgttaagacagaaaagaggtcatgggagctagggaagacagaattcaggaacatccactaactacagcccagctactgttacagtcattgtctcacttagctaacatttcttaagcacttccacgtgactaacccatttaatttttataactcttattattatacccatgctatggatgaggaaaatgaagctttgaaaagccatatatcttgctcaagtttgcacgttagtaaatgcagggtccagggttggaacccacagagtctaagacttttcttaggcactgtatgatactgactctcctaccccagtagggtgctgcatggatcctcagcacaacctgtgtggtagatactcagtccacgtgagacaaaagcaacaaagagatgtgtggctgtgcatggtggaggcaaggcagagggaaagatgaggtggtgggggggtctcagagttccatactgtggaatcccaaggcatgacaccaagaatgtcccaccggtggcgtgggaactctgggaatgccaatgttctaagggaaactggctggacaaatgctgcccttctggccccagctgcattcaattctaaaaaatgtacaactagaatgtgaagccaaatgcctgactccttcatcatcctttgagggtcaaaaatgggtgacatttattattttatatttttcagactgtattgtaaatttcttgagagcatagtttttttctttttcttctttttttttttttttgagacggagtctcgctcttttgcccaggccggactgcagtggcgtgatctcggctcactgcaagctctgcctcccgggttcacgccattctcctgcctcagcctcccgagtggctgggactacaggcacccgccaccgtgcctggctaatttttttttgtatttttcgtagagacggggtttcaccgtgttagccaggatggtctcgatctcctgacctcgtgatctgcctgcctcgagagcatagattttttatgcacatagaatatctgagcaacttgagttgtatatatagagtatcaatatatgcaaatcaaataaaaatgtgttgacttgacatgttatgcctgatttgaataggtgcattgcaacagtattagcagttaggcatcctagcactgtcaactgttgaaatggtcatttcggcaatagcaatccacaagccataaacaatctactcttaatggacactgcatgtgctaagtatccagagcctgatattatatgattcgcctcagaaacattcttaatatctatttctgttcctttatagggtttggttagtgtaaaacaaatatatatgttcagacaattaagcatttaaaaagtatgaatatttacaagcattaaaatgaatttccctataattataattaacacataaatgtaggaagtatactattgcaagcaagatttaaagaaatataaacttctggggaaaaaaacctggtacctttcttgctcaattaaactgttaaaaatgtctggttaacctaattttctcccaggcccccaaagaggcccttgtctaggatattgacatgtttgaggccattctgtgactctgagacttcaagttagttcctggcactgccttggagccctttcttcaattatagaaaataactgagttttctgatagcaaagaaagcctttctctacttgataacttacactcagctttttcctacaatgttgtctttatgctttcaggcataaaggagaaattgactttcagctctgtcgtggtgtttctgatcccttagctctgtgaaaccaaaagtgtgagtgcttccacagcctcttccttcttgtgggcctttggagaagttattttccattgacctgaacatgactatagaagagaactgaactgaaaccatccaggagattgcagtggtttcttctgggtcttcatttacgtggcccttgtccatctttcctctctgtccttgacattttctgaaattaactttatcaattgtttctagtcttaactcccttgagctgtttgcacaaccttatcttcccatagtggctgtttacccaaaacagcctttataaaactcagccatcgatgaattctttccatactatttgtccaactgcattcagagacaactcggttcctgcccctgagagccttctagaaatctcttgtgaaagaaaatgaagaaaataggctctttttaaagtaaagatgtgagccatctcaagtgtaacccaaaaagtcttgctttgttccaggactactgagtaatgcaaatatatatatatatatatatatatgtgtttttttttttgccatatattctcacagcagaataataaatttcaaggtgaaaaacactaaaggtgatatgtgaaattcaccatcttctttgccaggtacaggtactgtactgtattaaacatatcttttattttttgtgtttcgattctctaacatcaaaggggccttgttgatcctggagggactgcccctcccagagctagccaattcctagtgatggtaaacaatttgcgctcaagctgtttacacaacaaccaatacaaaccaatcctgcagagcctgcaccccaaatacctcctccatcagggtctcacactaaccaccccaggccaaggtatcagataactaggaataacccctaggctccagagattattcaaattagccaaccctaaacctgcttaccctgtctggccctttccttcccatgaaaaccatggtgaaggttcttgctcaagctttctctgctccctcagtctccggactaacctggggctttcccatgtgctctcttgtggcgtggcatggctctttctcttgggatgagtataacaaattctcttttcaatgacaatcatctgatctgttagctttaccatacctaaataataataaaacctggccaggcatggtggctcacacctgtaatcccagcactttgggagaacaagggtggagaattgcttgaagccagcagtttgagacaagcctagtcaacataatgagatcccatcgctacaaaaaaaaaaaaaaaaaaaaaaaaaaaaaaaaatagccatgccaggctatagtcccagctacttgggaggctgaggtgggaggagtgcttgaacctaggagttgaaggtgagctatggttagctatgatcttgccattgcactccagactgggagacagagtgagaccctgtctcaaagaaaaaataaaaataataaaacctgtgttttaaaataggtacataaagagaaagggataaagggtggcaaaagaggacagcctggccctagtactctggtcattcaaatgaacttggatgaaatgtagttgctctgtcagttatatttagcaaaacagtcaccttgtattatatggggtataatatagtactcaacagagccactataaaaagctttgatcaaagtgtccacattgagatgttgcatgttacaaaaggtgatgaggtttttaggggtccttgacttctgaagcacagattgagtgccactggaaagagagcttttgaagaaaataaaagtagtccccattcacctaaacaataacactaaggatttaatcatatcaaatgttctctattctaatatatcccattgaagctgcatcatggaaaactcaatgtgaaaagcaaagtccctatgagactgtatccttatttagggcttaacttctgtcactacctctggagtaaaagctgcccaaaggcagttttacctgactgtatccctagcagctggcacacagtaggtgctaaatatttatttactgactgaagaaatgtttctgataatctttgattaacagagtgagagataatataaaatatcaaagatgcccatttaaggaattcaataagtggaagaatgactttggaattgaaagttaaagctactccctctgatccaaactattatattcccacaacattctgccacctcttggagggtaatctcggacacttatttggtgacagtggacatcttggcatctcctggctgttagttgaccactaaaccccattcaattctgcagccctcaggctaacagctagccatcaatgagcattttccagggattgacaatgcgctctgacaaatggccgagctcctggggtgacttggataccattatttcatggtgtcacttaccaaaggctctagctccttgcggtctatgaggttcatctctgtgacaaagtaatagaagtgtttgtagcaggtgttgacatgggcctctgcacccatcacaatgacccggtcgaagtggtggatatagacgtggacaaagacccggaaaaggcggcacaggatcttcttgcagatctgaaggaagttctttgggaagggaacacctagagaagaaaaaaagaagaaagaatgaaaccatgatgggatagatccttttcctctttcctctaatatgaaaactgtctgagggcaatgctacagggagactggcacccgtcacaggagtcatagggagtgtgtgtgtgtggggggggggggttggtagcaaactagaaagcaccttccacctccccatcaaagggagcagttgctgcgactacagccaacagtggccatatagggatggaggcccagtgttgttagagcttctaatttttcaagataattcagaaatttagagttatacttggacctgctgcattttttaaacattagcaattaacttgaagttttaaaaagtaccatgagtcaaaataaaacatctctataagttacactgggcctgcaagctaccagtctgcaaagcttttcctgaggtatactgtttctgaggtgggcaaattcaataactttcacagatactttgcatcacagattcccccttcgtctctttgaggaaggtaagagttgggaggaggtcttgtttttcataacacagaaagggtgagtggtcatcgaagtcactcagatttcccgtctgatgaccactactcccagctcagtaaagcaacaaattgcaggatcgcaagcccacgtcctttctccatctcaaacactgcttaagctgttttgttatttgcactgtccttaagtggtgacatgttgtaatgggttcctaagctaaacagacattgtttgaattcttactctgctccccttccagctgtatgactgtgggcaagttgtttgacttttggtttctcatctgtaaaagagcggtcataataaggtcttccttaaatggctgggaaggtattaatgtaagatcctcctacagcgcctagaacatagtgaaagcttattaaattgataatgtcctcccttttctctacaaggtaaggtctgttgttataaggaaaagaattacccggccagatgcggtggctcacacctgtaattccagcactttgggaggctgaggcaggcagattgcctgaggtcaggagtttgagaccagtctggccaacatggtgaaacactatctctactaaaaatacaaaaaaattagccgggcatgtggcgtgcgcctgtaatcccagctactcaggaggctgagccaggggaattgcttgaacctgggaggtggaggttgcagtgagccaagattgcgccactgcactccagccttggcgacagagtgagactccgtctcaaacaaacaaacaaacaaaaccaacaacaacaaaagaattacccttgtcaaagaaaggtagaaatgaccactagcctttcagcaaaattgtagaactatgcacggcacatgccccaagtccccaggaagcctggagttttgctgtccttccctccacagaaacctagcagcagctgtctggtgagacactgtaatgggatcacctgggaccccagggcaggatgagaaggaacatgtctggcaggcggcagtgacaagatctgcttcccttgggtcccaacactgataatggcttttctttgaaacaaagtggcaacatatcaaatgaacccagggagaagttctggcactgcttgggagctgactgcctgggcaacagatgctgggatttggggttgagggtgcggtagagccaaggagaaggtggagggcagccacatgcagagtttatgggctgctttctcagtggagaggggcctgcagaactgctgttgccacactgggggcgggtctggagtctttgaagcctgagtcccagaagtgatgaaattccctctaagataggtatgtttccttcacatggggagtcctgtaacccacctggtgacaatgccaggaggtcgacatatgttgtcttcacaatgtatctgtggaataggttttattattcctattaatgtttcatagataaatagcactgaagctcttcagcatgaattctgttgctaaaaagtggtagggctgggatttgaaccaagtccgcctgactctaaaatccaaaaaatgagtattacagagtacaacgctctctcttcccaggttagaggaaccactcgattgtcaagcacagtgaggcatctaaaagttactcttcagtggcacagagacataaataagcaaaagaaaggggatggggacagaagaaggagaaggacagaaaaatgtccacagcatcagaagccacaaccagaggcaagaagaggtcagctaacatactctgctgccttcaacgagagtatgttagctttctctgcccaggccttaagaccacagacctgggattaacagtaaaaagtagtatttactgagctcttactatgttctaggaactgtgccaagccctatctatagattagctaactgagccctcagaacaggccttaaattacttccatctcacagataaagaaatagatttgggacaattaagtagctgcccaaggtcacccagcggggaaatagtagaggagagatttagccagttagtctgactccaaagtccacgagcactgctcacgggctctgcacacacttttagctctgaagcccttcctttctgggcagctcaaactccctcaagtgtgctcccacttctcctcccctggttccagtctcatggaagctcaccagatgctgggggacacagggactttcagctgtgccagtttatctgtgtggcccttatagccagcccccctaccctccacactggctacagataaggcaaagttttggacacactgcggatgctcatggcaattgctggccccttttagactgtctccaagcggctctgttccccccatctctgccactgctcagctcagaaatctcagctgtgccttccattccatacctggtctctgacttgtctctggccttgaagggggtttgcctcttgcctatccattttgggctatggctttagagtagttggttttgcaatctggaagacctagtttaaaatactaacctgacttcttactagctacagcttatgtagcctatgtagctagtaagcagtagggctaggattttaaactaggtctttagtttaaaatccagtcgagtcttcatcactcaactttattataaaactaatacacaaatttactttgtagtgtttttattagtatctgtactgtgcttggcactcaatggaactttgggagtaagttcaactttcattatttcccacctgaactcctcgggtaggtaggactccaggctcagaatctcttggctctggctgctaagtcaggccccactcttccaccattccctccctcccatgtaattcattcttcaaaagcaaaagctgcaaacggttcaagttgagacatgttcagcatgcactgcagtcaccccaggccaactccagacactgcaaagaggttgggagccctcaggagcctaggaaaccccactgggttctctgctgagtcaaagacaaaatccagctcacagagagtgggaaaagaacaggaaagctacatgcatttgaaaaattcttatatttattgatggttcagaggccaattctacagtttgcatactattttcacccttttcccttctgccttacagacgtccagatttgtgtgtgtgttttaaataaacctcagaaggtgggacttggaagaggttatcccttcagatggcgagacctcggatgtccaccccttctgcagactctggaactttctcattctatgtaactaacctcatggcagcaagatagaacaagatacagcttgctgacccactccctttcctggcaggctccagagagccagttcatgaaaactgattgatttgaggtggttttctttcttcatggtgctgcaaagaagtatccaatctccattacataactaaaagaaaagggaattccaaatgagggctgatctgtgtatgtgcaatgtcatttaattccagtgacaccctgagtagtggaattattatttcaggtttttcgtttttttgtttgtttgtttttgtgtttttttgagatggagtctcgcactttcgcccagtacagtggcaggatcgtggctcactgcaagctccgcctcccaggttcatgccattctcctgcctcagcctcccaagtagctgggactacaggcgcccgccgccacgcccggctaattttttgtatttttagtagagacggggtttcactgtgttagccaggatggtctcgatctcctgacctcgtgatctgcccacctcagcctcccaaagtgctgggattataggcgtgatccaccacgcccggctcagttttttttttttttaaatggaaactgaggcttagctcagttaaatcatttgccccaggccacaagggtaaaaggagatagagatttggcttcaaaactcaggctctttcttcagcatcctataggttctatggtgtcagggaaggtgagggacaagaataccattttattttaatttattcattgtttaaggacagggttttactctgtcacccaggctggagtgcagtgtcacaatcacagctcactgcagcctcagcctcctgggcccaagcaatcctcctgcctcagccttccaagtagctgagaatacaggcatgcgccaccatgcctggctaacttttgtaaatgtttttgtggagacaaggtcccactatgttgcccagcctggtctcaagctcctgggctcaagcgatcctcccacctcagcctctcaacatgctgggattacacgtgtgagctatcttgtccagccaaaaacaccattttatgacctgcacttagcttgcttgtggaaggagctcaaaaaatgtttgttttaaaagaatccagctcagcaattggaagaagaaaggcaactggatcacctcgaacggacacttggctagctacaatggcatcctggacctggggagctgtgcatggctgggtctgagcaaagggcaacccgtgttctacatggcacaagtgacccaacatcaggaccataaccaatgccctccttctgcctcatgagtacataagacacgatagaccctccacttcagtattccccattatgtgttttaaaaatcactattcttgagagatccttggctaaaaagagaggattctgagaccaaatatattggcaaaaatgctgttttcatagaggtttacaacgtacccaagcatagtaaaggatctgagaatatctgtagcaaaaaatcctatttaaatctggattcccctttgcttataatagctattgatttaaaacacagagtctgtaaccagaactcctaggctttatttctacctttaccacttattcacaatgtagccatatgcagatgatgtagtgtctccaagcctcactttccccttaaagaatatatcccttaaagaaaaatggggatatattaatgttatttgtagcttagggtgttgtgcagattaattacataaacatctaaaaggtttagcttactgccttgcagtattctattgtgaattgttagttttagtatcccattgaccaaatggtctttgtgacaaactttgggattaaattcctggctatttattttcatgatagcagtcttggcattaatacatcaattctggacttgcaaaaaacttacagtggcaggtactaaataagccctggagtataatctaccttgcattattttctactagtttctcaaacttatgtcttatattgctgtaagttctctgaacaaagggactgtgttatactttgattccacctttgaaagcacctggcacaggcaaggcagggaatacttcatcgatcaaaattgaatcagaaaagagcagtggtcttatttagtcaagatgtgaatccatcatctcctgtttgggggaggcaaaaaaaaaaaaagaaaacccacagcagaaaggatagctttttgccagactcctgatatatatagtcctggcatggaaggctgcatgttgcttttggggagaagagaaaactttgcaatgaggaacactgtgatccagcctagggtgtggaaaggaaaaactctgaaactttctttttatcattgaaatcttccttcttctctttttttttttttttttttcaggtagtgagagttaattttcagtcactgtactcagaaagttaatgccagacaacattaaccagcagtcctaactgaaatagattgtatatcttaagggtttggagttagattttgactagtcttataataatccagacaaaccatcagcaataataccagactgttagatatgtgcctgtattgatgatatagaaaacaatctttgattacaagatctctaagtgatttgcaatcaataattgagactcagaacatgcccttctctctatcctaccctgagctaccaccagtggctcttagcttaaaagctggaaaatttcagactccaagaagttggcccacattgagaaagtgttcagactagtgctccacagagaggggatggatatccaggtgtccaaggataaccctggacctggatggccttgggtcatgtgatgtagcttagtttctgcaaacggaccagtactgaaatggagttaatgagcctgaaacagggccagctgagctcaagttttggagtgcgccgaggcaacatgcctaagcagaggccagaatccaaaccaatcactgatacaagtttctagcaggagtctgctcaccagttagactcaaagcaagactagagttttctgagcaattaggctaaggaggaggcaggccagggtgctggggtgagggtggagagtaaggagagtgcaggcctggagtctctcttgaaggcctgatgagacagccttgtagccctgtctctgttgctcatgaagccttggtactcagtcaggaacccgcatctgacagagccctgctgagtttatgaatgtgtctaaccacaactttctgatctccaagccacattcagtgtgagagctaaatcgagtatgaaacgtaataatttctctgaggccccatgcagatttgcctttcatctctgccttaggaaatctcctttctccccaagaaaatttaataaaaattccagtaatttctgcacttcaacccatttttctttcttcctctttccctcctgcccctcccttccactaagccctcaaacatctcattcaatccttccttttcaggcacctctgaaagaaaataagttgcctaaatggcttgtgttacttattttatcttgttatggaggccaaaaaaggaaaaactcctttagaatatgcagaaatgcttcggttgacgaaggtccaggagactggggggtggggatgtgtgttctgagctggctgttaatcattcctgttttcatcattttcccttttctttggaagagaaaggccaacacctgggaatgagactctgatctgtgatcggtgctgggctgaacctgggcttttgtggtctgaagagtaagaaccaaaaggttgtctctggggatactggagaactgcccccaaacacctcaagttctgcaaacaactggcagataggcccctttattgagcacctggttactgcctcttctttctttagagcttggctcagtgtctcccatcatccgcagacccagcttccctggcatctgttattctgctcctgaaattttcctgcatagatcacacatggtaattccacatgtatctgtgggagtctctgcttcaggtctgttacctgctccagactggccactctgtgagagcagggacggtgtccagcctcctcacaagtgtctccttagtgacgtctccttagtggcctggcacctggagcagggtgggtatggaataaatacttgctgaccgttggaatgagagctgagctcctgtgccgcctgcataccctgaaatcaaagctcaaagaggtgaagggacagacttgggctttatagagctagtttgtgatgaagagggatctgaattcaagtctgtctcagagcctatgctccttctattctgccaggaagctttgtagggtttctacagctcctttcatctcatgcaaatacgattgacacagctggggaaacgaaacttgttagaagacaaggtggaaaagggtagtttggcttttactttcccaaatgtatgtgtcactgggggtttaggacactggtgaaacgcctggctctggcctcaatcccatttatgattccagctgtgggacttctgtgctgcttgcccttaagcaactttgctaactgccaaaagcctctgttttcttgtctgaggaatggtgataataatacctagctcttcatgagaccacaaggactaaatgagaagcacagcaccagcaggcacacagaaggcatctggcaaatggcagccgatgttaccaacgctaggaagacggctcttctgaatcaatgccaagacaggggtggcaggagggcaaatgaaacaggacaggtgaagctgcctcttctccaaaggataaactcttcttggaaagtatacttggaagacatgtcatatattggaagagcatgtgaactgtccaaggagcttccaaaggacatatgatgaaacctgatttcctggccaatcctttgggacccctgatggcatgtcaacaacaaccagaagtgcccatgtttctccttgaaactgttattcatgtctgagggcatttgtgctgtcccttctgtcttcagagtccagtaataagagggatgtgaaaatccctctacaagtcataaaaaccactcattctcaatagttcatgaataaaaacaacatcccacacacgtggaaaaagaaaacatacctcctctggcagcgtggctgagaacacaccatttccaaaatacttgcaaaacaagatgcaatcggatcacaaggcaaaaacaaaacaaaacaaaacaaaacacatgaacaacacagatgtttcttaataatatatatcctcctcctcttagcttattctcttgccccttcatccatccattctcctgcctcctgctctctgtctatatatatacatacatatacatatatatacacacacatacatacacacacacacacacacacacacacacacacatacagagagggagagagagagaagcttcgtgttcttgctgatgctgatgaaaattcagctgcgaggattgattcctcttagcagatgttttgtgttatctcagtacgttcctcaagaaagtgtctgttcgtcatgccaaggaaaacaatcctgtgtagcaggactttgttcctctgcctaaaaaaagagaaaacaaagtccccaaacaagctgacagctgcaaatgcttagaaataaactggctactactctgttttccaactccctccctctgcccctccccagcccctttgtgctgtcctccagtctgttatcatggtggttgggccaaaagaaagacaaacagtggtatgtgattatatgttctcaagagagtcttaattctttcagacatgccatgtgctgggcataggaagtgctgtttcagccaccccaaggagcaaccatgagtccagcgtgcctgctcgtcacacctcctcctacccctgagcgccacttctgagttgctcatcagcatccccagctcccagatggctgcctttgtcccctgctttcacagcatggatgtgaaaggagcagtagattaagaaagacccaagataacccgtgaaagatattcactgtggattgacaataaaagccattagaaacaaaccctagaccgtgtaaacctgaccagtttgctgaaaatcaaatgggacaaatgagccagagctgagaacaggatgttaatgaacttcattggttctggaaagtcaggctgaggtaccaggagtttgatcaggaatataggtctaggactaccacaccttctggtttttttcatgagccccaaccagaatttgaaagccaggttctttgtcatggatgtaatattgtgagtatcctcacaaataaaactattctttattccccagtagaatctttcttccattatgtggggacaattaacaccaagtcttgtcttgaacagttgctgatctctaaatttctcttcagccccactgcctccttcctagctcacctcctgcctagtttatgcaggtcccttgtaactaagcttcctttctttactcctgcatttcttcaatctccacttggcaggtgaaggaccttcccaatacgcaaatctaaccaggaagcctgtttttctgcataaaactctaaagcagcctcctactgcttccaaggtgaaatcaaagctatttaacatgcaggcaagaccctttatgatttcacacatgcagtggtccaccatcatttctggattctcccaacttgcatgtaatactccagccatctgaagctacgatcctctttctcacttgcttctgggcgttgctacatactggagggttggtagctggaaacctcttcctcagcttctccatttcgcctgactaactcccatttgttattcaaaccttaactaatttgtcacttcctctagaacgtcctccctggccacctcaccctcagtctaggtaggcatatcataacacccgctgcttcttccatgacaatactaccacatcaacttttaattgtcctttttttttttttttttttgtctcccaggagactgaaaattgtgtaatgtcagggatctttcttgttcatagtcatagccctggcatcgaatgcatagcagaacacggtggttctccatatgtaattattgaatgcaacggattgaatgcttatgcccccctcaaatgcacgtgttgaaatcctaattcccaggctgatggtactaggaggtggggcctttgggaggtgattaggtcatgaaggcagacaccccatgaatgggattagtgcctttaaaaaggagggtcctggctgggcgcggtcgctcaggcctgtaatcccagcactttgggaggctaaggtgggcagatcacctgaggtcgggaattcaagaccggcctgaccaacatggagaaaccccgtctgtactaaaaatacaaaattagccgggcatggtggtgcatgcttgtaatcccagctactagggaggctgaggcaggagaatcacttgaacttggaaggcagaggttgcggtgagccaatattgtaccattgcactccagactgggcaacaagagtgaaactccatctcagaaaaaaaaaaaagaaaaaaagagggtcctttttctttctccatgtgaagttatagcaaaaactgccatctgtgaaacaggaagcaaggcctcaccagacactgaacccaccagacactgaatctgtcagtgccttgatcttggacttcccagcctcctgaactgtgagaaataaacatttgttgtttataagccactctgtttgtggtatttttgttgtagcagcttgaatggactaggccagtgaataaacaaataaccatagaaacctgagttgtgcgggagtggtgaagagcttcccctgcttgggttccccttacttttcccaactccaagcactggcccttgagtcacaatctgaaaaccactgcttggtagaaagatctccatggaattgctataggcccacgtttaaccaagtcacgtctaaggagtaacgctaccgtgaacattaatacacagttatctcttcacaccttgcagatctcggagagaaacgcatctatcagatttttactgataccgaggaagaagtatctccctcttcgaattgtattgtacatttgcattgatgtggttattttcatctaaataaagtcaaacaggtagttttccagagttattaaagtttgcaataagccagatttggttggcaaatcatgctgagacacataatgggaggaggtgggggcaagggagaagatagcaatgtcattgatcctctttgtacagttgggggaacccagaaagaacaattggaacccaacttgagcggggctttgcagagccaaagggaacagtgacccttctgaaatgaacctgagataggaataaaactgttgggggatcttctccagacaaacagaatctgagggaaagacggtgagtggatgctgaggactttttccacctgacatagaggggttaaggcagcactgagcaagaaatggtgagtcattgcatttgcatgtaagatcccgcgaaggtaagttgaagggatagggaagaaaccagaaatgtggctctaaaatcttatctctgggtcaaagtcaagctaaattcatgaactaattcaagtaaattatttacttgaatatgtcttaaacaagatatcacatattcacatgccttcagggattacaaaggaacatgaatgagtaaagtaggctgggtgtaatatgatcgggagtggcgtggactgtgccagcctggagagtgtattatgcaggaaaggaaaaaagcctctcagccttagctgattgttggccagcaggaatatagatctaggactgccagaccttctgttttttttcaagataatccagaaatctagattcttacatgaaacctccccgtggttaaattttagttaattcaaggacactaaaaaattttcaaacgttttatttattaacattatttagtcttatatagctcactcagcctggaagttgactctataagctgacagcttaattttaaaaattcaaatttaaaaattaaaaaagaaggaaagaaaaacactctcgtagcactgagcacatgaaacacatggatcttggtttccaacatcattttttaaataaaggaatcagggccccttggagaaaatggctgattctaggactgaggcaggaaatataaaagatggcctgggacaccttagtgtcagaaagaaaggaagtgctaataaaaacacaatgacaggggcgtaggagccaacctgaaagagctccggaatggcccaaactggaacaatctgagcaaaaaaatagatggagtagttttgcattataacctaaagtagaaaataaatatctgtgagttcacactgatataaataaatggttggatagtaaatagggaaaagaaaaatctcctgtgtagtgagattccaaatatgtaaatactccctgttcaaggagatgaatgaagctcttgagcgtgggctatgcttggtgagttgcttccaaagagtacagtataggtggctttatagtcaagaaacctggcaaacatgaccttgaccaagtgatcaaggttaacatcaacagtgatcaatcgtgttcatagaatatggctttgatacgataagtcgcttcacttctgtggtctccctccccataacccataagccctatctaaccataaaaaaaatcagacaaaccaacactgaagaatgttctacaaaacatctgactggtagtcctcaaaactgtcaagttcatcaaaacaaggaaagtctgaagagcctaaggagatgtgctgactaaatgtaatgtggtatcctggatggaatccaggaacagaaaaagggcattagggaaaaactgaatactgtgtagagtttaataacagtagtgttcatgtgttagttcctcagctgtgacaaatgttttgtgagatgttagcgatactggaaactgggtgagggatatatgggaactctgtactatctttacaactttttaataaaccaactattctaaagaaaatgtttatattaagagtttatttatatttaaaaaacactctgtgggtcaaaaatatttgattggctccagaggccatgagtttgtacgttttgatttacgcactaacatttctgtctttactgttatgctctgatcaggactggctacataatttgcagagccccttgtttagaaattattaagcacttcaagatggcaacagcagagtcttaaaccaagcatggggccattctgagtgcaggtttcatgactgtgaagctggccctgtctctgacatgtgatatgatctgaacagagctgtggagtcaggagtcatccttgccagatacaactcccactatacaccctttgtttgttcattaactaatttaatagctaacaatagcaaatatttatttgtttgcagatgtgctagatactagggattcagcaataagcgaaagagttaaattgaataaggtcatgttatacctaagtttccagcactggaagttgacctaaggacctcccccaggtacagacacccacaaggctcatcccctcaccctctctattttcccactttcttccatctcaactgcaatactacctacctacaatgaaaattctatagaaaaaggatttcttaagttccaaaataaaatacataaaagttttttgtgactattatataatatttgcaatttaaagtctcaattacattggctccgaagagaaacttttatttcctgggcatccaatggcaccagccatgtaaatatccttatcccaaaaaaaaccaacaaactctgcagttgttttccctattttgtggatgaaaaaatactgttaaattgaatttggccaaaagccgcctcctctactttaagtctggtctaaaggtttgtcagtacctaatgaacccaacttgatgagtaaacaggctatatcctactcttgcagcaagtagcctagtcttagccaatcacagtagctgaaccacagacagacatctgtttaaacctggttcaaataaggcaaatgcccagctgtaaccgatccagctgtttctatacgtcacttccgttttctgtactttgctttttctgttgataaatgttatccaaccaaacagcagccctggagtccctttgaacctgttctggttctcagggctgcccaattcatgaataattctttgcttgaataaactccattaatctgtctgaagtattttttttttttttttaaataatgagaaactaagagaggctgcatcacttgcttaagtgatacaggtggtgaagctggatttaaacctagatcccactcactttgaaacagccacttcccaaataatataccctctacccctcaaaaaccaaggcaattcctttaaaattattaacttaatcatccagaaagtaccctcaatggttagtcatggagtttaaaaagtcctcaactgaaataaattactgttagactagtagccaattttaaggtccttatgaaacacaacttttgaggagaactggtcttttggaatttggtcttggtgaggcaggagtgggaagaggagggagaggacagaggtgactaaagcaatggtctctctagaacttgacattcacaagcagagatgagaaactggtgcctgcaggccaaagtcagcccacaggactgtcttctttggactacatatttttaaaatgctaccaatatttagaaactggaaactataacacaaagacgaattcttgcttctcttggaataactcagaagacctggcacaactggactgagattcccacatggcagcagctcagtaatgtctgctccccatacatggaagatgctgtactcatctgaggagccccattcattccatttatttatattgccagctggacccttgagaggaaaagttacctgtgattgcaaatttgattacagcagatggtgggcacttctggctaggtggccttccttgggacaggtgttggccattttagggagcaggggctctgtccaccatggggccaccccagagtggggtccactggcctgccacctgctcctttacattgggccatccatcccagctgttattcaagctctggccaaaccacttttgttttgtaaggccaggtgaggcttggttgcatagaagatgtcttttggccatactggaaaatcattaccctagtaacactgtctttgagtacctcatacttgcagcttctttgttctcccagccccagcaagcactggagtggggtagtcactctttttggttctccgtttaacataaatgtgcagaaggcaccatttacttgttttctgaacggaatcccagggagcatgaacagacagacttctggggatgatgaaggcacatgggcttcatgttttgcaatacaagagttttctccatatgttctttctttattaacattcataggtggtccttgagttacatatgcttaactttcttacctcctgcatatttgcacactacatggacattgctaaattccctttactagggtgcatttgatctatgatacattaattatagtggatgctttggtgatgtcacacagaagcactgtggaggagtgtgtactcgctagaggagaggacaaaagccccacactcaccccatgcatcctgaggagcctctagcaacccctgctgcctaaccccattagaagaaccaccttgcagagcaaaagcccttttgcccagcacaatctccctaggttcctatgatgattctcacatttccaggtcccaaaggcattagcacccattgggaccttaattaacaattgtaagatgctttctaattctctgaaaaaacttctaatctacaaatgcatgctttgtatttcaggcagacattgtagaatgtatttacaagaataggtgactgcctacacaaattcttttggtctaatcataaaagtaatattgtttaaaaattagaaaatgttatcattatcacccataatcccatcaagaaataatcactggtaatattttgttgtgttatcttccagtcttttttctgtgtgtgtatgtatatagttttgttaaaagtacaattagagtcatactaaatattcagtttgtatcctcctttttgtacttgacataagtattagatattctttgaacaatgaatcaccatataaccatcacacagactcagcaattatcaagacaaagtaatacttagatgcctcttcttgtacatatctttgacagttggtcctgacaattttccttggctaaattcttaggagtggactaaatcccatttacattacattttacattaagagttcatgaacactttgcattatactccacaatagatgtttgtttcatagaaaatattgaaatgaaatgaatgagcactatttgtcttgcagtgttggtacccgttgcacacactgagtttcccagaagtatgcatgctgccgttagaaaaaaatggacacaggactcaagaaccaaagctataaaaaggaattagtagtcttcctttgagtatagcagtggttctcaaccctggctgtgcattagaattatccagggaacataaaaaaatagaatggcagtgtctcacactagaacaattgaatctgaagttcctcagatgattctaatgtacagccctggttgagaaatactggcctacagaagtgattctttaagtgtggtctccggaccagcagcaccagcaatatctgggagcttgctagaaatgcaaattcccaggcctcaacctagcagcactgaatctaacacttggggacaagggtccagcaatctgtgctttaagatgtcctccagaaatcttgatccatgacaaattttaagaaccacaggcctagaatattcctggctcaaggatctagcttgcttaaccaagtgggaagtctggctgaagatttacagaatctggtgtctgacttgaactcaagtctctcgtctcccatttattagctacacgatcttgggcaaatgacttagcctctctgaggctgtttcactgtgaaggacataaggatcttaatagcatctaccttgttgggctgttgtgaggattaaagggaaaataatgaatggtattttccaaaaggtagaacttgataaaatttgctattttcattagccatcagagaactattactgtggtcaggagatcaggaaggaagcctccgaggtggagggagacaactgatctgtcagtctgaacacccaaaacagatgtttgtttcctaactcttttccaggcctaggcttggatttagattacacctgctgtgacacaaatacatgaatctcccaggatgagacgatgagtcattctctcaggagctgtcttcacactacggaagtgctgaaaatacacggctagagagccgggcttggtcatctggacctcaaaactgccaggggtgggaggaaggggagaagggaggggaccacccttctaacacctagaccagtgttctcaaacgggagccctgagaagcacctggagtgctcactgaacacagactgctgagctgcacccccagagtttcagtgagtctggggaggggtctgagaacttgtgcttcaaacaagttcccaggtgaggtttatacaaatctgaccacactttttatgctaaattgaaaacactggcaaagttcatgaaactgcaaggcaactgaactgtgacctataaaaagttttaaaaactagcgaaatgttctctaagactttcacatttcctctgtaaaattcaaattccgtttgacattctatttaggtttgccccagagtaacactggccaactttacagaagtgtggatagtgacgttcatttgaaccctaggtcccccacagggggttgaagggcagggtgatgggcaagcccagcctgtcttgctctgctctcacaggtagtggggtaagaaatcattcactgtcacctctccttcccccaagaagccaacacacatcaatcacttagactaagagtttgtatacaccacatcatttaattcttcctgcaatctatgaggtatgggctacttatgtctcaatttttacagatgaaggaactgaaactaagagaggttaaactttctgaagacacatagctagtaataaggatcttcaggtcagaaatcagatctcaaaacctttgcatttctctttctgacctacacaatgagtagaagagtctttgcttctagactgaaaagactgtgtgtgactgagaatgaatctcagctggggagggaatgaggtcataaggatggatgctgcatctggacatgggtaaaaagggacacatattgctgctcacctactctccagcaggctctgatgtcagctctggacaaagtgaacaggaggcaaagctggccctgatcccatctagttccctcaatgatgtggccagaatgattacattcaccactactcctggcgcaagggcaaaagccagggtttagtcccagaactattggaaccagggggcagcttggccaaaggaccgtgaaggtgagggccggggatctggtgtgccagtctgtgttcttcttccccctgtatctcactctatggctttctggtccattctcccagcccttgccagccctgatgactccctgacccagaaccacacctggggaatcctgtgcatctttgagtattgcatgtgcatgggcagagctgggcatgtgaccaaagtgataaaggaaatgaaggtcttatcacacagggaggctaggagaagactggaaggatagggctcaaatatttgaaagaaggtcatttggaagaggaaagggaaaagaaaattgcaaaccacttatccagggccacaaagctaacaagtgctagagtggaattctagcccacgtcttctgagctcaaagctcaaagcttgctctctttccactgctctgttctgcctcctcagggtcagaaggaaccccttcctttaggtcagcatgaagacaaatttacattgcctaaggtgtccaaaatgggatgcattgtctcaggtgatagtgagctccccaggctggaggtgttcaagaagaagcccggagaccacttgcaagggttgttggagcggggattcaggcaagggaagatggttttcatctctggttgcatgttaccatctcctgcattgcttctcagcagagtggattcccagacccccttgtgatttactggctcttgggtgcatctcaggaataggtgacttttaaagcacccttggggattctaacgcacctttaggaattactggggtttccttcaactctgaaattctatgacttgagtttttggcataagagacagctagctgtggggtgacagtgctggtgacaacaatattcgataattactgagggtttactctgaaccaggaccagtcattacctcactgagtcctcaccacaaccacaggaggcaggtactaccatcatcccctgttcacagatgaggaaacgacagaggaagatgaagtttcctgcccaaggtcacaccccaaagtgttggaggagccgggctgtgagggctgcagatcttttctccttaccataggagcagaaggcaccaagtgagacctggtccaaagccattcagtccaaggcaggttctgaacaaaagcccccagtggttaatctcccaaataaaaactacacagtccaggaagcaccaggagagtgaaacagaccctcagatcttgaaaagattataagcactgaaagagttgcaaagctctcaaggcataaagtctaactatttctttggtctaaatatatcatatttggtttttcaaaatgtaaacttttcaatatagtacaaagtgtacctaggtaaatcttactgctattcgctcacctaaaaataaaacaaaacttgttcgttaaaagtgcttccattcagttatagaatattcaaacaaagtgtcattaagtatattgacacaacggttaaaacattaaccccagtgaaactcctgatgtgccagttcagcagaacccacccacgcctttctgggaaaagctggatcaacccctgtatcttgcaagttgtgtctaaatcctcacccaccacgaggtctatgggcccccactagcagtgcaactttagtgcatacccattctccaccaaatatgttttattttccctcttgggaccaatcacaaagttctggggaggggccaagtgcagaaaaagagataggattttttttttttttttttttttagacagaatctcactctgtcgccaggctggagtgcagtggcatgatcttggctcactgcaacctccgcctcagcctcccgagtagctgggactacagacgcccgccatgacacccagctaatttttgtatttttagtagagacaggttttcaccatgttggccaggatggtctcgatctcttgacctcgtgatccacccgcctcggcctcccaaagtgctgggatcacaggtgtgagccaccacgccccgccaagagataggaattccatactataagggctgaagccactgggcattttccaggttgaataaatgccttattcaactaactctcattaacgatgactctgggccaaatggtgggaggagtggaggtggtccagcttctggcccctccccacccccacccttgtaaatcacccttgttcttgctgtagtccagggctcttaagctattcaagctatttcaggatccatcccccacctgcccaccaccccctcatagttcctaacccctcataagagattagttaaaacttataaaagggaattgagacagcctaaatggcatcaaccattcaaagaagatgtctggggctttccacactgcctaaggaagttcaatttaacctgggggtgggatgaggcagagccaactccaccttttcagatctagaaatcatctggggaacatcagttcactacctctcactgggctcatgatctgggtgagctttggaggaacttgtttaacctctctaggtttcaggctcctgagctgacaagacatgcagctgagatcagtatgcctcaaactctactgcaggcatggaggtgctgctgaatggtggaaggagcaaggaatcctgttttcctcttatctatccatagtgggtgtttaagttctcggtagaattacacttgacaaaattaaagtttgaaaaatcctggcctaggtaatttctaaggtgccttctggacctaacattctatggctctgacactctatttcccacaaaaataaatggctgttgcctctcggtgttgcctccccagtccctgctgatctgaggactgctaaagacttaacacatcttccctgaggctggagtcctggggctacaagtctgtctctgccaaaagactgagaagctgcctacattttctgtgcttcttgggaccctgagaaccctgagtggccctggaattctgctaagtgcctatggaaaccaagccagatgtggatagcagagaactgggtgtaacggcaacaccagtcatcgcactctaggctgggccctttgtggcactgcctgattttgtgatggaattaaagatgttttccttacaggtagccctagaacttttttttcgtttaagagacagggtctcactctgttgtccaggctggtgtgcagaggcgccatcgtagctcattgtatcctcaacctcctgggcttaagcaatcctcctgcctcagcctcttgagtagctagaactataagaacgcaccaccacatccagctaaatttttattttatgtagagatgacgtctcgctatgttgcctaggctggtatcaaactacggggttcaagcaatcctccagccttggcatctcaaagcgttaggattacaagtgtgagctaagtctggaaaaagtaacattaaattgatgaggggtggacattaacctgatacgagtgggcattctctagcttcgggccttggagtcagaaagccttgggttcataattctgacatcccctcagtctgctctgtgtctttgagcacattatttcgtctaagtgtcagcttttccatagttcaaatgagcgatgaaatgacatttgtatgtgttgacagcttggcatagtgtcgggcactgtaaatgttattgttattattgccaccactttgtactaggtcaattcctcgacagctttaatatgtgatgagtactgaaaaaagcaaaaaagttaaggggctcaaagacacccagctgtgtggaacaaccactgcttcagatatcagatcgattctctttctacacagccttctctgcctaaagccccaggttccccttaacacactgagtaggatcaactgttcctagttattcctggtgccctgactcactctttcatccagaagctagaaagatgtgtgctgtttagaagatcagggccaatccttctccaacccccttcacccccatggctgagggtggaaaaatgcacctaatcaatccgggcatgttgtgagttccttcaccatgattcagacaaacaggtccgtggctcctacctaggctgagaaaagaccagaccaagaattcagtggaccttgccctcccaaggcataataaaaacccgataaatgtgaacttgcagtaagatatgcctctctggtgtgaaatgagaggtgaaggtgatatatatatatatatatatccatccaggggccacttgctatgttattcactgcagaactggtgctttttgcagttccctgaggggtatgaaactgccagtgcttccctctcccctacccaatccaattaaatccccacttcaaagccccacaataatctcatgaacttccaggacttagtgctatgcggtctttatgtgttaaagatatgaatgatgaaacaaataaaactaacaagcaagaaggtatttgggggagaggagaataaattgattagtaagatcataagagagagtttagcagggaaaagaatgtggggggagaagaaaatgtccatcaatagacacttattgtgtggcagccactgtttagacctgaaggtgagggggttaagagcgtggatctaggactcccagcctacccatgttcacaccctgcttgcacatgatcacttggacaaattatgcaacctctctgtgccttggaggtaataacagaacctcacccacagggctgtcatggcgatgtcaaaaattcatatatatgggagcccttacaacagagcctggtgcataaaaagtggtacagaagaatttgctattattaataaagtttctcatttaatctctccctctcatttctgcctttatgaagtggcagggttcaggttttatagttggagaaactgaagcacaaataacttatgtgggtaggaagttgaagtttgggagttcaaactcaggctcaaatgattctagacaaataacagagattcatgaaggttacatgagagagggccagataacctgttgaaggaattgacagaatggacttggggtggctcctgggtcaagtcaagaaggacaagctgcttttttatatgtggatatgggtgtagagggataactagtcctagaagcagattgttttccctttaaatcaggacagagctgctctgtgaacccagtaggctggtgcctttaaagagtgtctgggagagatctatgtaaatacatttcctgttcaggtgctagcacactgcattgttcatttattatttatactgcgctctacccaaaacatagtgggtacttattaaatggttgcaattaccttacctatgttggcatgagattaaatttattgtattgtctagcatttccccaaagtttgctctggatatagcaagatgttccttaaaaaaataaagtgaatcatagttaaataaaatgccatttactcaagccccttccaggaaatttcctggtatagataagcattataaaggctctgagaaattctacagtaaagaaacctgcttattttcaatgtggtgtttcccaaacctacttagccacagaatccttttctatataatagaaactttggggaatattgaagttacccaactaaactttgacagccctgcaagggaggaattattattcccactttccagggaagctcatctagtaggtcatggagccacggttagacacccacatctctgcctctggaacaaggactgggcctaagttcatacactttttttttaaactataaacttaaggaaacaaactactatcatttttcatgaatggtttaagtgcacacctgtctaaagctgagaaacagaccagaagctgacctctgatggcatttggtattggttccagagatgggactgaggagatcctgttatttcagagctcagtaattcaaacaatctcaatccattcatcttggcaactagctggcacacccctcactggactaatgaaaaaaatctggccatttgacagcaaaatcattcttattaaaacaattgttccagaattcattcttccacagaactcattcttccagaacaattcttccagaacaattccagcagaactcattcttccacagaaaacagtggaggtgaacgtgctttaggactggaaggcagcaatgctctttccccaatggctccctccagtatttccctggcatggctgggtgtcagacggaagcatctctgtcccccacacctgccaaatgcctctctgcacagtagcccagctgttctgccagtgagtagcatcaggaactgagacgggtccttctggcccatggcaccacctgtgccttgggggagaaccttgggtgagggtgagacgctgagcctggtccttgcccagcagccccagcctccagtccctctgccaggaacttgggtcatgtctctcacaatacgtaggttggccaggcagtccctgtcaagaggaagcaggatgaacatttggggacaactaagggatggagataggcaccttatcctagaaagtagcatcaagtcaaagctgtttaattatcgttgcatggccctgctacagggcaggaagcaggaaggcaaggggatgaggaggggggcaaaaggagggtctttagaagtcatttgcctgaacatgttttcttgcggaatttcctctgtagggtttaacatactcctctgaattcttatattcacgtaacttttttttatagcaaagtaggacacacaaaacaacagtgattcttttttgccaaggcatatcaacctgatcaacaatttattgagcacttccaagtgtcaggccctgtacgaggtaaccatgagacagagtgacaaataagataaacggaggaggtaggtcaggactgactggtggttttgaaactgtattctggaggttttacaaaggtgcctaaggggccttggtgaggtgtcagggtggtgaggggttgagagggtggggtcctctcctgcatacctgccctctctctcactctgtctctccccaccaacttaaacagctctgttctctgtgttttcttgcagggagagctgttgggagacttaatttattaatgtctataaagccttcaggaatttttgaaggtactttctgcagggcaggtccaggaacgggactcttattaatcatgcaaagagagatgccaatattgattgccctaatggattctggcagagaaaacacacttgaagttaattgtttactgagagctttcaagcagtgcaagcactggccagacctggcacttgctcaagcacctacttgctccttttgacagtttgctgtggcagctgctaggacaagccctggagcaccttgaggtttggatgcttctcatgcaaactcaatgaagggtgcctccaggccttgtgaagagagggaatgaagaagattcgctgacactttgccctcagacatgtctagggagatctgcaacctgctgagcactggacacctgggttgctgtgcagacatgtgcaagaagcacatggacaagccatcctgctgctgcttttccttgggcttatgatagtcataggcaggaggcagctcatagaagacactgggtgcccaagaatgagtccaagtttcgagtctgcctcccttgctgcctcatttgtgactttgggcagccgacttctctttttaagcctgtattttctcatgtgtaaatcaggggacagtgactgttcctatatcatgggattgaggggtttaattattcatggaaaatgataagcacatggtaagtgtccatttcagtattatcattattattgacacatgggagaggaacgattcaacaaagccaaaggaaatgttcagtaacagcaacaacccatttgacagtcttggtctgggagtaatgcttgtcaaaatgaaaactaaagcagattaaaggacctgctttgttgatgcaaattttcgatcttctcaggaacagcacgaataatttttttcttcacatgctagaatgcataaatctaaaacttctctccttagagagattcaccagatggaagcgcttttcaaaggaatttcaaaatctatatatgtagcacaaacagggtcatgtggaacactgtaccagttgtcatcacattcttgatggcccttaaggctcagtctgcctgagttccactgatattttatgagctacaggaattgcattcagagcacatcttgaaggaaaatgtcatgaacttatctttccaggggccaaggcagcaatcaaagtatcagctcacaactcttgtgttatatccctcattcaagcacattcctctctgcaatctacttgctcctggaggagtttctggaagaagtgtgagctctcatccctcctaaggcatgtgaacgcagcacacctgtaatttcacagctgcctgcagttgccacagtaatgcaaatgtttgtgttggcttctccgtgaactctggaaatagcagcaaaatgtggcagagttgcttctgcgtaccaaaataaaagttacaagcttgtgaaaatgaatcactgtgacttaatgaaatctgtggcctaaatgtgtgcttgctgagaaaactgaagttggatgcctcctttaaacagaatgaaaggggagacatgaatgaataaatgaataatcattcatttaaaatatttatcatgggtaggaatcatgatttctaaaattctgtggggattttctactgaagggacttggtaaatttacaagtgtaattaaggattaaaggtgatgagtcttaacaggcagaccattttatacacacctgccccatattctctcatcagatgcctatccctcttttggaaatagtaaagagcctggatctgaacccagctttgctgtttccctgtgtaagcttgggtaggtcactgcacttcagtttcctcatctgtaaaatgagaatcataataatagtgccaaagtcactgtgctgctataaggaattcaataagctaatatgttaaaaatatttagactatgtatggcaaattcctatataaatgttagctgctgcaactactattattatcattatcataattaccatcagattctcctggtacattcttcctcctccaggataccctaaagttccctgcatcaccaacactgatgggaatattttaaggccagagatatcctctttagaaaatggttagagttatagcatctccttgaccactgacctggattaacgtttcggatggattgaaagtcaccttgaaagacagaaagtacaggctctgagaggctaggatggaaaacaaggacagtacattaaatggagaagagagtttgtctcgcagcaaggggtaccacaaggggttaacatgtcagagtcctcttacagccatgtttctcaactagaaatgattttgccccccacaggcaacatttggcaatggctgaaggcatttttgcttgtcataattgggagtcagctaccactggcacctggcaagcagaagccagggatactgctaaacatttaacaatgcacaggacagcctcccatagcaaagaattatccagctcaaacatcaatagtaccaaagtttaaaaacccagtgttaggataaaccttggaaaaaccttgtttccaaaggagcttccactttaggttgcacataccgttaacttccaggtacccaagagctaatctagtttccaaaggtgactgatttgcgtctaaaatgatttatgtaggaggctactctggtgatgcagcaatgatttattactaagcactctcagctcccagagacagaggctgaggagctggcttggtccccaagcacccatacagctttcatattagcactgaccagggggttattacctttatttttagttcactcattgaaatgtctatatatactaggctcagagtatctttttttttctcttttatttcaataggctttgggggaacaggtggtgtttggttacatgaataaattcttcagcagtgatttctgagattttggtgcacctatcactcaagcagtgtacactgtacccaaggtgtggtcttttatacctcgccacccccaaccattcccccaagtccccaaagtccaatgtatcattcttattaggctctgagtcttcggagatgattcttcaaatttaacctgtctaacacatgttgaatatattcttttcctttcccttctaagcatgttcctgccttcaatctcccccatctcagtacgtgccttggccatctccctttctcaagccagaaacccagtcaacatcctccgtgtcttcttccctacccattccataatccacaggcagatcctatcgatgccactcctaaattcatcttgaaagtttcctcttccctctactgccactgccctcgcctgaccactgtaaacaactttctgaatagcctccccatttttagtcttgacaatttctaatgaattctccacacaatggtctgagtaatcattttaaaaataataattaaagctatcactcttgacctcctttgatggtatcccactaatgcttccaataaaatccaagccctttgccgtggactgaaaaaggcttatatcaggagtactcatagagtggtccccagacctgcagcatcacttggaacttgttagaaatgcaaattttcaggctccaccccaaacttactggatcagaaactctgggagtggggcagcaatctgtgttttcacaagctctctggggagttgggatacatgcttgaggctgagaaccactgctttatgtgctctgcctcctgcctatctccctgcgaccccaccgtttcattccactcctctttctgattacgctgcagccaaatgggcttctttccaattacttgaacatgccgagagcttctctacttcaggtcctggcatgcgctgttctcactgctcggacacttttcccatctctcttgagatgcctcctctgaccaccttttctaatgtagctttctgacccaccctcgattctttgtggctataatcatggttttcttcacagcactccccatcactagttgtattctgtctttattttctagcttccttatgattatccggttctttcactagtccattagctccctgaggccagggctctgtctgttttattcattaatgtatatgctatggaaaccacagtgcttggtacatagtagtaaataaattaaaggcctgaatgaattagcacttttaagtcacttttagtctagtgcagaaagagaaaatatgtggcatacagctcccatttccagcctggaccgagaccgaggagacatcaccacttgatctccagtctttccctcttaatcctggatatggcctctgaatttttcacaaccctccactctaagcatctgctaaaaaaataattaaaaataaaaataaaataaaagttgttacttggaatgaaagtagaagtacaccaatttcctaaatcaccaatttcctaaatcatatttcaatagttgcatatatatatataaaatatatatgtgtgtatatatatatttgagacggagtctcgctatgttacccaggctggagtgcagtggtgtgatcttggctcacagcaacctccgcctacctccgcctcccaagttcaagcgtttctcttgcctcagcctcctgagtagctgagatcacaggtgtatgccaccacgcctggctaattatatatatttttgagactgagtctcactctgtggcccaggctggagtgcagtgggcgatctccgctcactgcctcctctggggttacaggcacccgccacaactgtggctaatttttgtatttttagtagagacggggttttgccatgttgaccaggttggtcatgaactccaggcctcaagtgatcctccccactcagcctcccaaagtgctgggattataggcgtgagccaccgtgcccggccaagttgctaatattatttatgtaccagacactgctaacatttcataagctttagttcccacagggtaactggcagacaggtaatctgaagccaggctgtctgatcacagagcctgcaatcagggcgaaatcctttcaccatagtgagaatatatgtattggagttcagcagtgagagactaagggcggagaacttaacccagttgaaggaatcagagggtgcaatggactgaatgtttgagtccccccaaaatttgtatgttgaaatcctaacccccaaggtgatattaggaggtagagcctttgagtggtgatcaggtcatgagagcagagccctcacgaatgggattattacccttataaaagccttaagctccagaaagcttcctccccgcttccaccacctgaggacacactgagaaactggcagtctacaccagaacctgaccatgctggcatcctgatcttggcttttccagcctccagagctgtgagaaactgtgtttacaagttactcagtctacagcattttcttatagcagcctgaacagaataaatcagaaaaaatcctggaggagttctgaagtttgagttagtcaggcagagaagtagagaagcaaaggcatgaaccctttactcacacctactcttttctgaaacgaggtcttgggaagaagagagctttggttaaatgtaccacgttcacaggatggtgtttggctgagcacatcctattcagaggcgactgcctacctctcacctcagcagattcttcagtaataatcttctttttaaaatattggcagtatatctgatcttggtgaagtttatttatataaatgaatggttgggtgtggtgggtaaagcttaaaaggtccctaggggaagggggcagagctttttaagttatttttgtgtcctggataaactgattcacctctcttgggtcaataatcccgtcatgtaatgagttatgttattgttggaagtgtgctattcatgtgcaaaatgtgatgctgaaaacgtttggaaaccatagacatcaattattaaactattttaatgaaagtaagtgtttacactaaatagcatctctgagtgtgatccaaaaaattacaaatcattctcaattgacttgcaatcaagagaaatctgcgtggagctggaatttatagcacagcctacacttccatagcaaccaactgatgtcacatacggaactcagacttccctgacgggcccaggattcagcttggaggtatcatatgttcagttaagcataaaagtgacttcaaatttagagaatgcttttcttcgaagagattaattttacttaatttgattttgagaggaagtgcttaaagcaaataagatgattctgctccagtattttaaccaaaaatagatgtagaaatctcatataattcacaaaattgagcttgacatgatgccatgcctctataagtctctatggcaaaaatacagaattctcaatgcagaggagagataatttcatatcagattcaatgcctttctataagagttcctggaagtactatccccatataagcagcatcagaatcccctcagaggcttgcaaaaaatccaaatttgggtctcacccagaactactgaatcaatctttgagggcagggctccagaatctaatattttaatacattttctagaggattcttatttagaaccattttttggtggaattcaaataaagaaacaagttttctttatcatatgtgggaacaggtaattcttgaacatcattgaagcttaatgagaaataactgcatagcaggcccctaggttgtaagagtattctataatgcaaagagaacgtttaaaacatctgcaaatatttggaggaaagcaaaatggtataccgtagtaggactagacttctgggtttcaaaatccaggaaattttaaaaattgggcaaggggatcaacataaagtcgcctacgtttatgttgccaaaagggcacttaaaaaagtctcactaactctcactcatttcataaaagggcatttttgcaccacaaaagaaaaaaaacaagaaagctataatcccagaataaaagacaatcctttacatgaacaactgtaggaataaagacgagccatttgatgtcctgtcctattcattttcatgaatggagctctgatacttgggaagctctcaggcagtggagagaccagtgttttggaaagataaaaaagtcaattctaagctcttcctcttgctagctgtgtgatttgggcatcacttacataaccaattggtcttggtttccttatctataaaataaagataatcatcgtcatgactattaatgaccttacatggattaatcaactgacatacagaagggactcaaaaaatgtccacattccctggttttgtcttctatggatttacaatctactaagacccttgttggacttgagacagacttgagacaaagtgttgcttgagataaaaaggaggaaaagtggctgattaactgattgtccctagcattttatttttagctttttttctcttgctttagattctgacggagtttcacattagacagattcttaatacctggctattactgactatctgaaatagcagttctacaccttgtttgtcacaaaatgcacagggtacaagtaaatccttgctataggtgtttaaaaggctgtctaggtcagttctgctttttctgttacgcctatttatgaagaagttatttccccaaagtaaatataggccaggtgattatttgtagagggcacaaaaataacttaaaaagcttgtttgtatagggtgcagagaagtgcatgattatttatatagggtgcagagaagtgtgtgtgtgtgtgtgtgtgtgtgtaacagagagaggtagagagaggaggaagtggaggatgaggaggtagttgctctgttgtggaactcgaaggacaccatcgatactgtattctatgtgaatgatgtcccattgctaattgtgttcccaaggagttgtgcaaaatggtagacctgggtggaggaaggcatatagataaatattattctacaaacagagttcacacatggctctgcaaggaatttaagaaaataacttcatagctaacattctttgagtgcttacatgtcaagcactgtgctaagcagtgtacagacttggccacattttattcctcacaacaaaccttcgattattatccccactttccagatgaagaaaccaagtcttaagcgaacacttgcttaagatcacccagctgatcaatggcagatgcaggatttgaatccagatctgtggaaatccagaatccaaactccatgtcattttgctaaaccactcctccaagtaaaaaaataaaaataaagataagatagaaaagagagatcttattgaacactcatgagtgttcagggagggttgttttcacttcttttcctcctcttaaaaggtagatgaccagctttggctcatattctaactctgtgaaggtaggaggcaaaagttttgtggaataactcattaatcaatccctacagcaatcacatctctgttttactggtgcagggggctctcagtgtttgtggttctttcatcataagttggtcactgtatttcctaaaggaatgacctcccttcttcaagaggtaatcacacatgccctgctgaactggacagaaagcggtagccaaatatcctgtcgtcaagcctccttcaagataactctggtgagtggttattttggaagtggctctaatctgtcatgttacacggctttgctaagactcactttattagctaccaccaagagctaataaaacatgtcaggaagtctctgtaagctgtaaaaacattttcaaaggtcactgccaacactctggacttcaatgactatttgaaggaaaagaaaacaaaagcagaggcctagagttccaaaacacagaactaccaaaagaagcaatcccaaatgagctataaagactgacaaacccacatgataccagccattggataaactgtgtccagaaggaggcttgaagaaaaggtacaaaagccacaaaatgccagtgagtaggcagcaaatttagatttagtgtataggaacctgacggtcacacctacttatgcttccagcacctacaatagagtcctttataaacaaaggagtaggtggcagagaagtaattaactttagattaaccacagcatagcaggcattcttcttaactgacttttttttttctattgtaaaagtaaacatactttttaataaaaattagtaaaacatagaaaaggagaaaatcatgttatcttaaaagctgggaatatagtttgatgcccactgtatatttcatgtattgagagtcatgctttgacagtgagatgtctcaagacaagtggctgtgagccagcagctctattagattgaaaatattgtattaatcattgagatttccattcactgctgatgagaggtccaggcacagaagagacaataacattcttatcttggcttaggataaaaaatttagacatgaaatctgtactttgtttggggggtggagaaaaggtcatctgtggagtcattaagtcgggatgtcttgttgtagaagcatcaaaagaccgctgaagcggggagatattgatcaaagggtacaaagtttcagttaggaggaaaaagttctgaagatgtgttatatactgtgttgcatatagttaatgcatatactgtattatgtacttgaaaagtgttaagagactagattgtaaatgttctcaccacaaaaaatgatatgagttgattcgtgttcattagcttgttttaatcattccacgatgtaaacatatatcaaagcaacatgttatacaccataaatacatataatttttatttgccaattaaataataaatagattttttaaaaaaaaaaagactgttgataggttggtatgccccagacagagagaggcaggttctatcctgctttggaacagttgctagcctgctcactgattgtgcatggctgtttttaataacttattgcaggcatcaacagggagcgaatgtgattcaatccttaaatactgcaacgctcagtgatctagtcaataacaggagataccatatgggtgtgttgtcccttcctttgtgtttctgttttctttttcctcctctacttgctaagaaaggcaacacagaacggtagcaagagcccaggtcctggagccaagctgaccagggctgagtcaggctcagcctgatttgctttctaactttaggctcattctgttgctcctcagtggcatctacacaatggagataacaataggactcgttcaaggagcacttgcaggattaaatgagacatgcttttaaagcactcagcaagcagcttggcatgtacagaacaatcaaaaagtgaggaaatcacaattattgtgttactggctgggagctttgaggacgggggttatgttaccttttttggatactgagcacaaggtgcctggccacttaaggtaggggtgtgggggagggctctaaaaatgctcaagaataaatgaatttggttaaatttatttcaggttcctttcctgatacactttccctacatgtatttttttccttctccaaaatagtaaaccacattttcttttgcttcaaacagatgtatcactgacagtaggttgaggcaattctcttattttcttgttcaagaaatatttatatttcttgtattattttttatattcagcagtccttttcccccttctctattcatagctttcgtccctgggggaactgctccctcagtcactggggctctggcaagtttgccaatcggttatccccaagcccactcctatccaccccaattcacacacaccagaatcattatttgactctgaggtcaccttctttctaataaatcctgtttcctactcaggttagtcagagtcagtttctgttgcttgcaaccaaggagccctaaatgatatgtaccttgttttttcttcctttctaatcatatttccttactactttatgtttcccatatttctccttgactatctaccactatttcaccttgactatctaaatttagtctccttccccactgaatatggcagaatttattccagtctgtgaataaggatgacatcatgtctcttctaataagttcagccctcttcttaactatcacagtgtctccataaaattcatttaccctcaaggcagcctgatttttggctgagcaaaatgttaattttagcatcctaggtgccctaagacttagctattacaatctcaaaatggtaacgcatttaaccatccacgttaaccctcttcattttacagtaaggaaaaaggaggacagacatttaatgacttgtgcaaggccaaacaccaaatcaaggacaaactagaatacaatctcctgatatttggtaagatgccttcatcatctttttgagcagcttttaaggaaataatattttgggcccattccaagcaaattttctttgtgtagtggaaaagacctttgtcataggacagtaacatctacaagacagtccttcttctttgttcaacagaagttggggaagagggaaaatgcaggaagaaggatagcgctgttcaagagaaatgcctcatactatttcttctatacggaggtgcagagattctccataactcaatcgttccaagtcatgtggcaggcctaagatgagacactacgattatgagttttacagaagtggcaaagagaaaaaaaaaaaaagatcatcaagattgctatattaacagccccttttaatataaggcttttcatctattgaaccacagcatagagttaatacatagaaaacaactctcaaataaatgcaaatcaataggctctccactgattattatataaagcaacacattacaggggaataaaccaataatgcctctatattttgaagtgttcactaattctgagtaattacctcctccaatggctctaatgagtgcaaatctgtgaaatttgactacatctttttccttatttaaatactatttttttagttcatagaaccctcacaagattctagtaataacagaagttccctcccaagaattgctttcatgactaaatattttataattcataatatactaatcttctatgtacaaataaatccttccaaagtacttgatagtttgtggaattaacttgctcttttagatcggctaaaccaatttctctgcaagtactctttagatcagggtttcttaatctcacacaatccacatttggggccaaataattgtttgttgtgagagattgtcccatacattgcagggtgtttagtagtatctacccgttagatgccaggggccaaaaagtgtctctagacatggccagatgtctccaaatctctcccagttaagaacctgtgttaggccactgataaattttttacccaagtctcccgtcttttgatagaggatccaaagataaatttatggcatgccttcttcaggaatcccagatcagcattctgggttacctcagtagaaattaaagcaaatttacctttaatcacacagcatcccggggaggagctcatgtgttgttatcttcatttcattgtggagaaacagaatccaatgtcacacagtgggacagagatgtctcctgaaatgtacccctcctcccaatctgggcagaaggatcgtcatctcacttactgccttcttcccttcaggatataacatttgctctggaggattttgtagctcagagcaagaactaaccaatggcaactatctccttgataatttagggcaagttatctaatctagagtcttcatggttttctttttttagttataaaaatgaagataataattcctacctgtaaggttgttactcagaattgaagatcacagtagacataaagcatttgacacagagtctaatacagagcaggtgtgcacaataaacattaggtctttcattccctcttcatggagaatctcaaaccaggatcactacatgagctaatttggaagtcatgattgagacttaaagagctgagtagaaaagcaagcagtgcatgtaccacctaccagagactgggtgagtgtggaacccatgtcagggatgcagaaaccactgtgacgcagaaatactgaccatgtaataccaccaagtatttctataaatagttacatataatcaaatactgtgataccttttaaaagtcacgtataatctgaatttactaagagagataccagggactgttgtggcaaattactcaaaaggtatatacaatttgtcaccttcacctaggcatccccatctctagttgctagtaggctgaaactatatgcaattgctgatgggtggctactttttttttaatctgcaaaatggcaattttttagcagtcaacctgagttctgggggcaggggggtgggaaacagactctttcaaatatttaaaatattgagtccccaagtggaggtcaaataaattattcttagttaagtgaggaaaactctgaggaaaccaagcccacatgagatctactattatcatgcatgaatgacattccattcttccctatctctctctttcataaactcaagatgcaaatttatagagctctcaaaataccctccagcaaaagaggcaggtgccttatcccacttcccagtggggccctgaattaatcacaggaggaaggctatgcctcatctgaaactgcaaataggctattaaataaaagagatggcatacctgtgccacactgggcagtacaagagaggagacgacgaagcacacaagggcaggtggaaatgcaaaagccaaatttcagaccattatggctttggggccagtgagcatcctgtactcagctcattcccacctggttgccctgttagggaacagaaagcactggggagaaggttagagctccaggaacttggctgagaggcaagttgctgaacaactgttttagagtatttcagacacccaggtggaccttcactgatggggtctggagacccttccattaatacaaatcttgaaaactgtcttgtgcacgtctctgaacccatccgctaatctgaaggacagagtgatataaactcccaaatttgtatattcaatcttaacctcttttccaagcctcagactcctttccctgactgccaagagatcttctctatcttgaaaatgtattagcatctcaaatttaatatgtccccaaatgagatcgtatcttcctacacgtgcctaatcctgtgccacatagctcagtgagtgctatcactactgactccattcctggaggaagaccttcaaacccggctcgaagttctttttcattctctccacatatctaaatatgaatccctcagaagtgtaatctcaagcccaactgctcctttcgatcccacagcccctgccttaaatcaggtacttacttctcccctggaaattacagctgcctcctgcctgtcctctctgctcttcactgccccttacatcagtctctcctgcaaactgctctcagaatcctcattcccaaaaagtgtttttaaagcctttatattgtttggacattgtccacaacacagttccttgacaaatgagaatgatagatataaataacttactttgtctgtgacagagaataataatacttacagtaattattgattgtattgttaattgtagatacagctctccaaaacctggcctcaacctacccttattcctgccattcacccaatgcacccacttttccccattgcggtgacctcctctcagttccatgagctcaacaggctgttttatgcccgcctagctgtgcacatcctgttccctttgcctggagggcctgcctccctccttccttcccaaactgccaggcacacagttacctttcaagactcagctcaaaaatcacctaggtaaagccttccctaatgtcctcaggtgaaattgaaatgaatcattcccttctcagaggaacatttgtatatttctactctagtagttcctacattatgtggtgatttatttgtctagactgtgaacacttcaagaacaggtgtgacatcactcacttttatctacctatatctagcacaaagtcctacttagagaaggtccattaacgtacatgaaagggatggccactggccttttatgatggttcttctagtgttacattaaatgtttaagacaatcactcaaagggggcagtttttcttagatgctttctagtccttcttttagcatttcttcaaggagagaatattaaatatctagcttaggcttctgtggagaaggcaaaagtatctgagacccataagtaggacatcacaaggttcctcatttccatttagttgtgatacaaattattttatctgcttgagaacttgtgttttgatctgtccatgacaaggaccagaaaccagttcaagctacggaaggcaacaggggctttacagtgatagaatatggcacccaagagcagaaggtgaagcccagcaatggaaccgggccagggaactgaagagcaggggccgggtgctcctttccagcatgggccacgcggtctgccttctctgcctcactctactccctggagccattcccttctgtttcacattctgtgagacttcactccctcctcatttgacacatagatgagccccagctggcaccctcagcctggaccctgtgacttttcgattcaatggctcacgactaacaacttccctctggatcttagtgcaaaagtcctgaaagaggggctgtaggtggcccagggctccttttgggtgacatacaagtcacgtgactgtctcaagtcagtgtccaccctggtccacggaggtgggacctgtgtcaacgacaggtgggatcacacagacaaaggcaccctcatctgggtctgtgagcaaagatagatgatctgaaacaggtcaaaggcagtactgacaactccacaggtatattaccccttaaaaaacttgccctacaagtacatttctgcctcacccttcatccctggtggctgtggcagtcttctgatctgctaacatccaaggtacctaatggagcacatctagaaatcaaaagttaaatcttcttaataaagtaatgaggaaataaaatcattaaagaacttcaaagcaaggaaagcaaaagaaaaacatacaggtaagcaaaggttagaaacttatggcaaacatactgatctgtctcctatctgaaatcagattttgaaacatgagtaaccacaacaattttgggagctaaacttcatttcatccattactccacatactaggtgggtattatgctctactagtttttttctggtctcttccaacagcctagcgcataatgtgcagatatttctgtcctgtagagaatacagcacagaaccttagagtcaaataaactgagttctgccatttagcacttgtgaccaagggaaatacacctaacttctctgtgtcagtttcttcatctataaaatggaaataataaagtcaactttgcagagttcttgggaatgttaactgtaacacttataaagcacatattcctgtgtctggcatatgaggaatagtcaataaacggtaaacatttggttgaaccacatgaagttaaaaattaggcaggtcataatgttatatgctcccccgatcagaggacctttattatagttgtgtatttatatgtttctatcattaaaatgcaagctccatgagagcctggactcggtctatcttgattcccacacaatgcccggcacagcacttcacagatagaaggtgttctatctgtattttttgaatgaattaatgtggataatgatgatgacaaagatacctcttctgtactgcctacatctggggacaattatagacaatacagtcctttatctcattgcctggtgtacaataggaacacgataaatgtctattaaaggaaagaatgagtgagcaagtaaatgaatgaataaatttcaagtccatatacagaaagtctaatgagaccactaagttaacaaaaattgctatgaaacttgtttttggtaattgctatcacaaaacaccaaatggggactgccttcattttcatgtttccagcaggccctttggtgttgtgtggacactatcagggttcacttggccccgtgggcctcccaggaaagtgagagaggcaaagtgctgaactgcagcctgccaagccaggaaaatttagggttgtaatgtgtagcttccagaagtctgctggcttttgtctgctcagagacagccaacagcttgcaattgtgcgatgagcctttagctgttggagaccctcccatggtactgtatatggctcatgctccttaacacaatttttgtcctaagagcctgctaagttgactccctgcatctctcaccaaacattcaaccttcccaacagggaagcaggttaaaagggagactagtcatggaccgaaaaaaaaaagtttggtatctggctctgatgaccactggctctgatgaccactaggaaagcaggaaagatcctgggctggattgatcaagaagacagaaaaaagaactaaagtgaagaaaggaagacttaacctagccatacatatgtctttaacatttcaagtaatggccagtttatatctctggattttagattgaagtcacatttaggggaggagaatgttctctctgcttttgacaacaaataaggagaaacaaagtatgaaaggtagaacatagttacacttaggagaaagtcagttactttaaattatttaagcttcaggaaccacaaatatgcacatatagggagaagggaaaaggaaaaagttgttaagatcccaaagagaaacacactaaagttatctctatctcctaaactgcttaatgcttggtctggctctttactaattttttttttttttttttttttttttttttttaagagacagggtcttaccctgctgcccaggctagagcgcaatggtgcaatctcagctcactgcaacctccacctcccaggttgaagcgaacccagttaatttttgtatgtttagaagagacagggtttcaccatgctggccaggctggtcctgaactcctgaccttgtgatccacccgcctcggcctcccaaagtgctgggattacaggtgtgagccattatgcctggcctctttattaaatttttaattgttatggatacataatagttgtacacatttatggggcacatgtgatattctgatacaagcatacaatgtgtaatgatcacataagagtaataggggtatccatcaactcaagaatatatcatttctgttgtgttaagaatattcaaattccactcttttagttattttgaaatacatgctaaattattgttaactatagtcgctctattgtgctaacactagaactcactcctcatatctaactgtatttttgtacccattaaccctcctcgctttatctccccctccctattatactttcctccatctgggtaaccatcattctattctctatctccatgactaccctttttttttctttttggttcccacatattaacgagaacatgtgctatttatctttctgtgcttggcttatttcacttaacataatttcctccatctatgctgttgtaaatgacaggatttcattcttttatatggctgaataatattccattgtgcatataaaccacattttctttctttctttctttccttctttctttctttttttttttttttttttttttttttgagacagagtctcgttctgtcaccaggctggagtgcaatggtgcgatctcagctcactacaacctcttgaactgcaaagttcaagcgattctcctgccttggcttcccgagtagctggcattacaggcatgcaccaccacgcctggctaatttttgcgcttttagtagagatggggttttgccatgttggccaggttggtcttgaactcctgacctcaggtgatccacccgccttggcctcccaaagtgctggatttacaggcgtgatccactatgcctggctaattaaaccacattttctttataactcatcttaggttgactccatatcttggctattgtgaacagtggttcaataaagatgggggtgcaaatactgatttcccttcttttggatatatactcagcaatgggattgctgaatcatgtggtagttttatttttagttctttgaggaacttctgtactgttctccatagtggctatattaatttacattcccaccaacagtgtatggggttcccttttctccacatcctcaccagccttaattattgcctttcttttggataaaagccattttaattggggtgacaggatatctcattgcagttttagtttgcatttctctgcttattaatgatgttgaacatattttcatgtacctgttagccatttgtatgtcttcttttgagaaatatctattcagaacctttgtcttttttttttttttttttttttttttttttttgagacagagtcttgctctgtcgcccaggctggagtgcagtggtgcgatctcggctcactgcaacctctgcctccggagttcaagcaattctcctgcctcagcctcctgagtagctgggattacaggcatatgccaccatgcccggttagtttttgtatttttagtagagacagggcttcaccatattggctagtctggtcttgaaatcctgacctcatgatcagcctgccttggcctcccaaagtgctgagattacaggtgtgagccaccacgcccaacctgtccattttttaaatgggattatttaggtttttaaaattgagttgtttgagctccttatatattttggttattaatcccttctcagataggtagtgtgcaaatactttcttccattctgtgggctgtctcttcattttcttggttccttcctttgttgtgcagaagctttttagcttgatctgataccatttttccatttttgctttagttgcctgtatttttgaggtcttaccctaataccaaaaccagacaaagacacaacaaaaaaagaaaactataggccaacatctttgatgaacacagatgcaaaaatcctcaacaaaatactagcaaactgagttcaacaaggcaaggataattcaacatatgcaaatcaatacatgtgatacatcataccaatagaatgaaggacaaaaaccaaatgatcatttcaactgatgccagaaaagcgttcaatgaaattcaacattgattcatgataaaaactctcaaaacctgagtatagaaggaacatacctcaacatgataaaagccatatataacatacccatagctagaatcatatcgaactaggaaaaactaaagtttttatctaagatttggaacaagacaagaatgcctactttcatcacttttactcaacagagtactggaagtcctagccagaacaattagacaagggaaagaaataaagggcatctaaatcagaaaacaatgaagtcaaactagccttgtgtgcagatgctatgatcttatatttagaaaacctaatgactccaccaaaaaactattagaattgatgaagaaattcagtaaagttgcagaatacaaaatcaacatagaaaaatcagtatcatttttgtatgccaacagtgaacaacctgaaaaagaaaccaagaaagtaatcccatttacaatagctacaatgcaatccctgtcataacaccagtaatgttcttcatagaaaaagaaaaaaataatccttaaatgtatacagaaccacaaaacctggaatagccgaagcaatcctgggcaaaaagaacaaagccagaggcatcacattacactgacttcaaattatgctacaaagctacagtaattaaaacagcatgatattggcataaaaacagacacatagaccaatgcaacagaatagataatccaaaagtaaatttatgcatttacagtcatcccattttcaacaaaggtgccaagaacatacattgggaaggacagtcttcttagtaaatagtgctgggaagactagatatccatatgcaaaagaatgaaactagatctctctctcttttcatcacatacaaaaatcaaatcaaaatggattaaagacttaatcgaagacctgaagctataaaactacttgaagaaaacactggggaaatgctcaaggacattggtctggccaagatttctttttttcttttttttttttagatggattttgctcttgttgtgctggctggagtgcaatggcatgatctcggctcactgcaacctccaccttttggattcaagcaattctcctgcctcagcctcctgagtagctggaattacaggcagctgccaccatgcctggctaatttttgtattattattagcgacggggtttcaccatgttggccaggttggtcttgaactcctgacctcgtgattcacctgcctcagcctcccaaagtgctgggattacaggcatgaactaccacgcccggcccaaagatttcttgagtaagatttcagccccactctgtgtaacctaagaggtctaggaaagactgaagcatcctgcatttaccatctgagtttagaaaaaatgtttagagcacaacatcagggaaccattcccagacgtggctgtggatgctgccatttcttgtgattctggagctgttcttttcatctcaagctactgtttacagaagtgttaccacagaattataattatgggttttatttagttataaagagggtttgagtcttccatcaaagggagaggaagcaactcactcagaagtgtggagaaaatctttcacactcactgcttgatggaattccagtagtctgcatggattcaggccagagcatgaacccctggggcatggagagcttgattttatggtgggcaggagggcccagagtactggccttccttcctctcttcttggagaagcagtggtgataaggtaggaaaggaagtcctgggcttccaccaggccagcttccccacccatgcagacttccttctgctccaaggaaactggtcattcttatctcttctgcagaaaatgaaaccagaaactcccaggcttatgaaggagaggctatctgggcactgggaaggtggagagaggcttcccagtgttgtctctggcaagacagtagaatccttgggaggtctatttgctcctaatattgcttcctctcgatttctttccttcagttttttcccccatttttggctctgatcctaaaacttgggctctgcattctttgataatccatcacacctcagatactggggacctgagacctggtcctacctgccctagctggtatctccactgaatcctcacaggcctttctatctccagagactgtttctggccactgagcccgatgcttgggacatcaatggctcactgatgccccagggcctcctcctaatctctggccgaggctgacacagaaggctcacaacaaaccatgtgcctccgaaataatgtgatgagcagagtaaaatctgttgactttttaccccatgaaagctgcatggtttaaatacaatagaggtgactcagctactggaaggatgcatgtaccacgtctgaaacactcagcaagctctgtggagttgatgaagcagggaaattgggagtgaaagtaaaaatttccgcttcctcagaaaaatctgcttgacactatctagcatccattcattagacttaatcttcagcctgtctgagttcccatgaatctatatttctgcactgagatggggcacgtattttctaccaacatgtgagcaaagggggaaatccataactttgacttccttcagttggcttcctcttggacctgggacattagcattccactaacatttggttacatgaagctacattttcccagtgcattattttgcatcttgaaagaatgcagtagctgtagctacaggacctaccatcaatcactgggcattaatcctcactgagtggccctcatgctgtaacctcactgtgcctattctgcttaaggtcctggtggttgggctgatggagaacataactcctggttctcctctcccgcctctggccccccagcgttattgccagggaatacacttgctctggggagctctgagcttaatggattttgcagtatttccccttccttcctgctacaaagctctggcttagcatgaaagctgccccagatccctgaacccatggcacccttcctgccttgaggaactcacccctctcctgcagatcaaggctcagtattagcctatataaaaagcctcctgcttagtcataacaggtataccaactaccatttacagagtgctcactatgtgccaaccagtgtacaagtaccctgtgggtggtattgcatataatcctcacacaaccttggcagctggcactgtctttattcccgtatcatagttaagaaaactggaacttaagttaggtcacatagctagaaagtgatggactggaatccgtccattcaacagatattattcatgtcttactacgtgccagttattgttctatggatcagggatatgttggtgcacaaaacagcctaaagctccttcccttgtggagctgacttccttctggtgtttaaacccaaagctgcttggccccagagctagacactatttaattcagagacgatcacagccacacagaaagattttctttaaaatgtttgatcataaccatgatgagataccatttcataccattagaatggttactatcaagaagataaaaaaataacaagtattggcaaagatgtgggaagtcacaaccctcatatactgctggtagaaatgtataatggtgcagccactgtggaaaacagtatggcagttcctcaaaaagttaaacatagaattatcatatgctccggcaattccacatctaggtatatacccaaaggaattgaaaagcaaggactcaaatagacacttgtacctcaatggtcatctagtagcattacttacaatagccaaaaggcagaaacaacccaaatgtccatcaatagataaatggataaacaaaatgtggtatatatataaaatgaaatattaattagccttaaaaaggaaattatatacttatgacagcatggtcgaaacattatgctaggtgatataagccagacagagaaggacaaatattgtatgatttatctttatgtgagttgcctagaacagaaaaattcagagagacagaaagtggaatagaggttatcaggggctgagagggaggggtggggatgaagagtcattatttaatgtatgcagagtttcagtttgcagtgatgaaaaagttctggaaatggataatattgatgattgaacaacactgtgaatgtgtttaatgccactgaattgtacacttaaaaatggtgaaaatggtaagttttatgttatatttattttacaactaaagaaacaaatttttaaaaaatgtttgaacttagaagaaatcgatccaagaacaagaagtcagcagccaattattgagggctcttgggaaccagagcacacccccattcattctatcagtggatttcaaagtgagtatgacatttagggaaataaagatgccagctttaataagacctcagctcattctttacccaatggggtcatttattcctaaatgcacagtcaggatagtacaagtgtaatgaattcagtctgatgaagatgatggcatgggaatattggaaactgacaaatttgagtcacccggttcaaaagtttttagatagacctataagaaaattgcacctagctaggaaattgcctagaaaagattttttttttttccttgagtttctggaaaatctttccttgtaagagctcagttgttcctgtgatgaatgtatattttgcatctttctggagttaagcacaggcaagctgaccactccagggttaatgctttgacctgtgctttgcctctccattatttccaacaacacttgctaatgaaaaggggcctgcttggtggtcttcaggctggacacatatccccagaatggtcaccacacagatcagtgttactttctttaaaatgaaagttattctttttttttctgattataaaattaataatgctcactgtagaaaatctggaaaatgagaaggaatctacttggtgattgaattatctttctctctatatagctatatgaatcacactacatataatcttgtatccctttattttttaactttacactgcaaacattgccccacgtcttaactattctttgaaaacatgatttttaatggctgtccaaaattgtatctgtggatatgtgattcaatatgatgaatgcgaatatggaagtctagcagaaacttggttctgctgtgagtctgtgaggcaatgatcttgttcatatatgcatagaattcttataatgtggataatatgtttataacagggtttgatacaatgatgtatccctagatatggcagatggggtcttccctaataagtggcttctttcctggtagctgtacctcttctagggaaaaggcacatcgttttctcagtctgaaatctgtacctgagaaagtcctggggttggagggaagggtactattgcagaggaggactccagctctctcttcatcccacgcaaggttcaaatttccaagaaggaacatctagcaggtgaatcaatgccatctaattgtttcagctagggcttgcagatttgtaccaatttcttgggattacagtgtgaagatcagaggccagagtgaggccatagacgggtaagagaggctggatcaggacagccatcatcagagcacacactgtgcctatttctagacctttaaattgtctatatttcctaactagtctcatcagaattaggcaaagtgtcctgaaaatttgaggcactaccacgtcttctaaatgaactgacagaagaagtcttgctcacatgtgaggaatgccaaggaaagaaacaaagaaagaaataaataaacataaaaatgggagagatgaacaggtggagcagaggggatttttagggcagtgaaataattctgaatgataccgttttgggggatatatgacaatatacatttgccaaaacccatagaactatacacaacacagagtcaaccctaatgtaaactatggactttagctaataataacaaatcaattttggttcaccaattataacaaatgtgctgcactaatgcaaggttctaataataggggaaattgtgggaggaaggggcatgtgagaaccctgtactatctgctccattttctgtaaacctaaaactgctcaaaaagatagtctattaattaagataaaaaaagaagatgcttgttaattaaccctgaaccatttatttagggtcgtttcattaacaaggagaaacgaaataattcacataatgtgtggaaggagaatatggggcaaaggtgatcaaaacaaaacaaaaacaaactgaggcttttctagaaatctacccttatgacgaaaaaaaaaaaaaagtaaaaataagataaaatcaaggagaggcagccatacctacccccattcagggataactagaaattatgcgagcaggaagagctgcttaaccaggtgcctttcctttcctggagattcttccccagagcaatatcttaaagattcctagtagacttctaataaagggtgggggtggggttgtttgtggcaaagcccccacctttccggattcaaaaggattgttgtcactcaacccattcatgcaatatactctttatctatacttcagtgctatgaggaaatgctcagtaccaggagtcaattctctttttgtttctatagttattagtctcttgtttggttttccttcctccctccttccctccctctcccttttcttgtttctaaattaaagcactgggttccatttttcccaaagcaagtcttctgaatttacagccatacataaaaaataaagcaaacattcttatttctagttaggaagagaaagaagacagtgatgggggtttaagcagcatcatctcaagatgaaaatgaaggcgactccagcctgctttgaacagaaacagtgaccgtggtgggttagcttattatagctggtcactaagtcaatagcctattgctgtctacttctgagttacactctgatggtttactcacatctccactggtgtatatatcccatggcagctctacctgtgagacgtcacagttgataggaacatggaccacgctgagggaccaggctggaccattcatttagatggattctccaatgaaaggcaccctttaaagaatttgctttagccatctacaggaccagagagggcaaatctgcccagccaagtaataacattaacattcctatcttctgtctcctgctcccaccctatgctttgacccaggcagggcccaaaatagcagtcagtagtgggagaagaaggaagttgaggaactgaggaggaattctgccatatctccatggctccattcccctgaggcaaatagcccaattgtagatcttagcacagcagagaggtcgggggcaaagggacagggaggagtcttatttttggaaggttattattttggagtgaattctccatttcattctcgttactgaaatgggactttttttttttgtggagcttaaagtgacatagactattaactgagagtgactagaaaagccacactggcaagaattttatcaaagaacaaagggaggaccactgcactgaataagttctttaaagggatagcaggagacaaagaataaagttgcattttggttgctgcacgagttatgcccactgataaagcagttacatgtacgtggctagatttgtttttaaaacttactctcggctattttgaagggactggattggagaggggaaagagcgaagttaggaatctaaaaattggagggtgttccagtattccagttgagacatgattacagaaatgacagtgaagagaaatgaaatccaacatgcaatagaaagtgaaagcaataggatttgaaggattggttgaaagtaggggtgggacagaggaaagtattaaggatttttctaagtttctgagcaactgggtaaatctcagcacaactgtgagccagagacctctgcaagagaagcagatttggtgtagggaagaaaggggacctctaataaaaccaagccatagctggttcctgaggctatttaaaaatagtcttccaaagagctttctttgaggtatctcaatgaacagaaggcgagtgctggaatctgagaagtattttaaaaactgacatatgtgttggctggacttaagctttcatttagcttaggagcaacaaatatcttggaacatctccatatcatgcctagttcaataaatctggatgggttctgatggaggaatacatgtgatctctctgacggctgcttccccagggaaaaccttgcttttcaaagcagatgatgtttgcccactcttgccaataaatgccaacttctacatatacgattaaatggcttcagagaactttggaccatgattgtgaatagccatgattcctggcagcaagcagggaagctgcacattcatctttcagtgttcagagcagaaccatctgtctaaagccacaaggccttggtggacacaagcagctgtgaacccggggggctcgttcatctgaaccagactgttgcagatgtttgcagctgctgagagcccattctgaaactcatggcctccattcaattagggctggtcagtgggatgaccctgaggattccccacatgaagtaagacccacttcttgcctgtgcacagctaatatgaggattaggtttaaaatgtcagactcttgaacaaaagtcagtttatcttggctcctgctactgaggttatactccctatggccttggatttagtgataaagaaccagttacacgtggtgcagttttcaaagtgctgcctcactacttaaatcagcaacataaacacaaggtgacacggtcatgaggttttttcctccccaataagtcaaatgcatgcaggccttccaagcagctgcttgtaggaattgctgctcagatcttcagaattcttatataaaatgagaaagaaatcccgtgagacagtttagctgaatgatactctaaccgcagttttatttattttttaatttttttttttgagacgctctgtcacccaggctggagtgcagtggtgcgatcttggctcaccacaacctccgcctccggggttcaaacaattctcctgcctcagcctcccgagtagctgggattacaggtgtgcaccaccatgcctggctaatttttgtatttttagtagggacggggtttcaccatgttggccaggctggtttcaaactcctgacctcaggtgatctcctgcctcagcctcccaaagtgctaggattacaggtgtgagccaccacgcccagccctctaaccagattttaaaatcctatggaataaaggaatttttagaagatggctttatgggtgtgcataatatgtaaagacaaatatgacagtttctctcaaacataggttaaaagtgaaatggtactgtttgcttttagaaaaattataaaatatgatttaattaatgtcaatttcctgcctctgaagatggctctaaagttatataatacactaacattagcagaagctgggtgaatgatatatgggaactatgtactttttttttttagaacttatctgtaagtctaaagttattttcaattataaaacataagaaaaaataggaattggagtctctgagtcttcccattcattattcttctctgtgaaagtgttctttcccgtaaaaaaattaatctggtcaattttagatgggattattaaaaaataaatgagaggcacttacattttatatcagtgtaaattttgcgttaattgtctcaacaggctagcagagccccatcagctaactgtgtgagaaaaatcctcatttctcacttccaaatggaaaaggtcctagctaatttcaatggatttggctttagatctaaaaacaactgcatcctctggggatgaccaagcagatgtgtaagtgtccccttaactgaagagctgttgctgaggaaaataaaatttcatcacatctggttctaaactgcaatacgagtggattttatcactcatatagatttcaatatggggtttcgtgcgtgtatttatttagttagttcacacagacatatgattagatttgcttttcacatgctttcacccctggattatctgtaggtaatcctaaaaggaaaaacattcaaactttgttggtatctgggcttgcaatatgtttttgtcctctcattgcatgataaaaaatgtatttggggttaatacaatttcctgattgataaaatgattttgcagcatatacaagtattattgaattctgaataactacagtttaataaactcatggaaaaggtttggctattgcagttaagcataaagatttcccttcatgatctcgtaggacctcataccttaagtataggtatgcttaaggatcagttaacaagagaaatctagtaagtggcatatcagggaaaaaagagcttttctttgaaatggcaatagtagagggacttcagagaatctggtctaatctccacgtttgggatttttaggaagtttaaaatggctggtgcttaatttgatggaggggtgggctgctagattcctttgacaacctgaaaaagctatagatattctacctataaaacacattcttaaagactttagatatcatttggaggttctgtggaacccctggagtaatttctttttaattttttttttttttttttttttttttgagatagggtcttgctctgtcatctagtctggagtggaatgccttgacctcctgggctcaagtgatcctcctgcctcaccctcccaagtagctaggactacaggcatgatgtaccaccatgcccagccaatttttaagttttttttgtagaggcaggatcttgctatgttgcccaggctggtcttaaacgtctggctttaagtaatcctcctgcctcagcctcctgaaaagctgggattaccggcatgagccaccacggctagctcatctttcctttgcttttcttcgtaaaacagaacaaaagatagccaccactccacgtctgtaaatgtgcttatgactactagaataagcaggggacacctgttaccgttagttacatctggagtttagaactggtgtgcgattgaaggggagaaagaaacaatgttattgggattttagacacctgggattgcttaaattattaccatgaagatacaggatgtattacttttaaaactcaaatgccggcagggtgcagtggctcacgcctgtaatcccagcactttgggaggccgaggcaggtggatcacgaggtgaggagatcgagaccatcctggataacaccgtgaaaccccgtctctactaaaaaatacaaaaaattagccaggcgtggtggcgggcacctgtagtcccagcaactcgggaggctgaggcaggagaatggtgtgaacctgggaggcggagcttgcagtgagccgagattgcgtcactgtactccagcttgggcgacagagcgagactccgtctcaaaaacaaaaggaaacaaaacaaacaaacaaacaaacaaacaaaacgtcaaatgcctgaaatgcatacatgagagggaaagaaaaagagagacaccctgtgctttaaatggaacaataaagtttcctttgagtgatcttattacagctcctctgctcacagcctccctgtgcccagctccaggaatcaacaattctcttccttgggatttaaaaaaacactttctaagcctctcagcttctgctgagaatccccaagggaaaagaaaaacaaaaatgctagtactttggactctagcagcaaagggatggtgaaaaaaaccaccgtttattgaggactcacaagtactttacatacatgagctcatgtgatctttacaccaaccctctggggttagaaaatagaaacacaaccctttggccgggtgcggtggctcacgcctgtaatcccagcactttgggaggtcggggccggtggatcacaaggccaagagatcgagaccatcctggccaacttggtgaaacccttagtacaacttggtgtacacttagtacaacttggtgtactaaaaattcaaaaattagctgggtgtggtggcacacgcctgtggtcccagctacttgggaggctgaggcaggagaatagcttgaacctgggaggcggaggttgcagtgagctgagatcacaccattgcactccagcctgggagacagggtgagactccacctcaaaaaaaaaaaaaaaaaaaaagtaatacaaccctcttagcttaaatcaggaagaattagaaaccctcaatagaccaaaaacaagcagcgagattgaaatggtaacttaaaaattatcaaaacaaatgtccaggaccagacagattcacagcagaattctaccagacattcaaagaagaattggtacaaatccttttgacactattttgcaagataaagaaggtaccctccctaattcactctatgaagccagcatcaccctaataccaaaaccaggaaaaaatataaccaaaaaagaaaactacagaccaatatccctgatgaacatagatgctaaaatccttaaaaaaaatactagctaaccaaatccaacaacatatcaagaagataatccaccacgatcaagtgggtttcataccagagatacagggatggtttaacatatgcaagccaataaatgtgatacacataaacagaattaaaaacaaaaatcatatgatcatctcaatagatgcagaaaaagcatttgacaaaatccagcatctctttatgattaaaactctcagaaaaatcagcatacaagggatatatcttaatgtaataaaagccatctatgacaaatccacagccaacataatactgaatggggaaaagttgaaaacattccctctgagaactggaacaagacaagaatgcccactctcaccactcctcttcagacaagagaaagaaataaaggccatccaaatcggtaaagaagaagtcaaactgtcactgtttgctgacaatgtgatcgtttaccttgaaaaccctaaggactcctccagaaagctcctagaactgataaaaaaaaattcagcaacatttctggatacaagattaatgtacacaaatcagtagctcttctatacaccaactgcgaccaagcggggaatcaaatcaagaactcaaccccttttacgatagctgcaaaaaaaaaaaaaaaagacttagtaacatacctaaccaaggagtcgaaagacctctacaaggaaaactacaaaaccctgctgaaagaaatcatagatgacacaaacatatggaaactcatcccatgctcatggatgggtagaatcaacattgtgaaaatgaacacactgacaaaggaaatctacaaattcaatgcaattcccatcaagataccaccatcattcttcacataattagaaaaaacaattctaaaattcatatgaaccaaaataagagctcacatagccagggcaagactaagcaaaagaacaaatctggaggcatcacactacctgattttaaactataccataagggcatagtcaccaaaacagtgtggtactggtataaaaataggcacatacaccaatggaacagaatagagaaccagaaatgaacccaaatacttacagccaaccgatcttcaacaaagcaaacagaaacataaagtggggaaaggacacccttttcaacaaatggtgctgggataattggctagccacaagtaggagaatgaaactggatcctcatctctcgccttatacaaaaatcaacttaagacggattaaagacttaaacctaagacctgaaactataaaaattctagaagataacattggaaaaagccttctagccattggcttaggcaagatttcatgaccaagaacccaaaagcaaatgcaataaaaacaaagacaaatagctgagacctaattaaactaaagagcttttgcacgaaaaaaggaacagtcagcagagtaaatagaaaacccacagagtgggagaaaatcttcacaatctatacatctgacaaaagaccaatatccagaatctacaacaaactcaaacaaattagtaagaaaaaaacaaacaatcccttgaaaaagtgggctaagcacatgaatagacaattctcaaaagaagatacacaaatggccaacaaacatgaaaaaaaatgttcaacatcactaatgatcagggaaatgcaaatcaaaaccacaatgcaataccaccttactcctgcaagaatggccataataaaaaaatcaaaaaagagtagattttggcatggatgcagtgatcagggaacccttctacactgctggtgggaatgtaaactagtacaggcactatggaaaacagtgtggagattccttaaagaactaaaagtagaactaccatttgatccagcaatctcactactgggtatctacccaggggaaaagaagtcattattcgaaaaagatatttgcacacacatgtttatagcagcacaattcacaattgcaaaattgtggaactaacccaattgtccatcgatcaacgagtggataaagaaactatgattatatatatatattccatctacatattccatctatatatttcatatatattccatctatatattccatctatattccatctatatattccatctgtatattccatatatatatatatatatatatatatatatatatatatatatatatatggaatactacacagccataaaaaggaatgaattaacagcatttgcagtgacccggatgagattggagactattattctaagtgaagtaactcaggaatggaaaaccaaaggtcatatggtctcactgatatgtgggagctaagctatgaggatgcaaaggcataagaatgatacaacggacttcagggacctggggggaagagtgggagggggacaagggataaaagacttcaaatatggtgcagtgtatactgcccaggtaatgggtgcagcaaaatctcacaaatcaccactaaagaacttactcatgtaaccaaataccacctatacctcaataacttatggaaaaaaagaaaatagaaaggtcagtaacatcttccactgacccagagcttgacaacagcaatgatcacatctgtattgggaggcctttaccatccatgaggggtaaccttgcacccaccttctccctacatggaagagcggtattctcacctccatttttttttttcagacggagtttcgctcttgttgcccaggctggagtgcaatggtgcaaactcagctcactgaaacctccgcctcccgggttcaagcgactctcctgtctcagccgcccaagtagctgggattacaggcacatgccaccacgcccggctaatttttgtatttttagtggagatgggggtttcatcatattggtcaggctggtctcaaactcctgacctcaggtgatctgcctgcctcggcctcccaaattgctgggattacaggcgtgagccaacatgcccggccactctcacctccattttataggcaaagaattgaggcacacagccctagagtgagttaagtgagagtagcataaagtgcaggtctttttgctcaccttgggtgctcctttcaaaccacgcagttctctacaaagcagccagagtagttcttttaaaacaccaggccggggggcgggggttacttcacatttctgctgaaaatcctcaactggtttctcgtcatcctcagaataaagtcccaaaaccttactgtggcctcacataatttgtctacctccaacttcctccatttccacactccagctgcactggcctccttgctagtcctcacacattccaaatgtggttccaccccagaaccttggtattcactcttccctcagcttggaatgtgctttctccagatgtcggagggtttgcttcttatgtcattcaggtgtggctccagtagctttcttttctgcccctactgtataaaatagcacccatcactctctagctgcttttcttcatagcacttatcaccacctgacatctatatctgattatggcctgcctctcctccccactctcaatgcagatataagttcaatgagagtgaggatttagtctttattgttctctgctgtgtcctcagtaagtgtcaaaacagtgcctggaacccagtaggggctccattaatatttgctgagtgaatgaatgaataaatacatgaatacgtgaatgaatgctacctcttttcagggcaataagttacaaatggaaaatagtgaggatcaaatattcaattcattcaacttgcaaatctggggctgatcttgcctttcaaataggtggctggctgagcaatttacatttcagctttcatttcccactatttcctcagttcattcatttaatcttccctgcaataaaataaatcaacaacccaccattaaatgcatagttcagtccaacttcaacgctttatttttagaggagacttttacaatagaggcatttggtaaatgtgaaatatgaccaacacctatcttggttccacctctctaattctgttgatatagtctgacctaggtttctagacaccctatggaagttaaagttattaatggaatgcaaccaagatgccatatttaatcaagatagctgaagacagattttatctttgttttcatgcattggcaatatgtagttttatgtgttgccaacaatttgaggggagtgatgcacttcttaagctttttgtatgacacttttcatgagatcagtctctgatgaatattaatgactttcaaaaaaattgtatctggaagagacaatcataggtcttgttgaagcatgtataccacaaattgtactttgcttgtaaattccagttacagaaaaaatttatcaggagacactgtactgtgatctttaaaattattaaatgtacacataaacatttaaaagatgaatcttgaaaattagttttctatgtcctgaatctagacagaaaaaagctgggaatatgtatctggtatatcttgatagggtctggaaaaaagtgttgttcaatagtcaatctggaaagaaggtgaatattagacgaattatcccaataataatgagcatgaaatctgaaaatactacagagctgaggctttacttatgggtccacatggagagccagaaagaacgctacatggcaagtcaggatactcatgctgttcaataaagcaaacatttttagtgcctattatgtgttaggcactggccttgcctgtgactcgggttcagtcattttactacattgggcttcagttttctcatctgcaaattgagataaatcttgccctgctgactttacatgacagttatgacaatcaagggtgatgaatgaactgctaaacattaaaagtcttttggtaaatattaatattattattgcacataaatataacagttttacctgttctgtgaatatctttggcccccatacatgactttttttgtaatggcaatactcttttttttttttttttaacttacctaagatttaagtcacttcttgttgcaagcaagcaactgttggtatgatggctaaactaagctactctcaccttacttataccctgatccttaaagaaggtatggagcatttagtgtggagcatttaaagagggaaaaaaaatcaataaagttggatttatggttatctgatttctgctaatctctttagaaagcctaacacttgggtcataacattcttcacatgtgtaataactggtttagtatctgtcttcactacaagagtagaagttacaagaattgtccactctttcaaatacaatgccttcatatggcaggcaaaacacacagaacatacatatttgtttaataaatgaataaactgattgagactttatgttcatcagagaaagtatcaattatttagctagatcttattataagacaggtgctaagtgctttaacatatattaactcatttaatcctctcaacaactatacgaaggaggtgctaatctgcccactttacaggtgaagaaataaggacacagaaaaattaagttactttctccaggttacatagctagtaagtggtggaattaggacatgaacctagacaggctggcttcagagtctgtgcccttagtctcaaggcaatacagtgtaaatgtctgtgcatgctgactacatacgcatcttaaagctctggcttcctgacagttaatcatcactcacatagagttagcctcttgacatcccctatgcttaggtatgaagctgttaagtaagagaagaaaaatggaaaaaggacatttactgtttctgtggcttcttaaagacactaagactacagacaatgaacttagaagaaaaatgattaggctgatttagaggttcatcccaaacatcccaataaccatgaccaaatgaagccatgtcccaagacgtgctagccacggacacagaataatgtgtatgaggctcaaactgaaggcccaaagagatacacaggaacagggcaggtccccagtgagtcatttcagagcaattgctttttgctttccttctcccatttacttcatttctcatctgttcttatatgaatcaaaccccagaactgcgaggaagataaactctgagtgattcttgctattgccaaacccagtgaaagaaccaccgggggccaatcataaactgcatggggacccatgactactcagtcaacatgacttctgcccaatccagtgggtgcgcagactctacaaagggcaaatgctgatggtgagcttaatgggataatgcaatttgtactggccaccgagcaaagaatataccagactggaaagccaatctgccaatcaactcatacatagtaagttcctaccatttgccacagattagaacacaagagttatgttggtgcatcagtagtagccatccatgttccatacttgtgtcgtaagaaccaaaactctagagagaaaccttccagaaactgtcctcaaccttccaggtctcttccagcctcttcccaagacagctgcattctgctctagggttctgtgaaatatgcctgtaatcttagaagtaaatttttctccaccacccataatttattgcttgcttgcttaaactaaactacctccagttagtttttgttacaggaaaatcctcattcaaagtaactgggggcatccaggcgcggtggcttgtgcttgtaatcccagcactttgggaggccgaggcaggtggatcacctgaggtcaggagttcaagaccagcctgaccaacatggagaaaccctgtgtctactaaaaatacaaaattagccaggcatgatggagcacgcctgcaatcccagctactcgggaggctgaggcaggagaatcgcttgaacccaggaggcggaggttgcggtgagccgagagcgcgccattgcactccagcctgggcaacaagagcaaaactgtctcaaaaaaaaaaaaaaaacaaaacaacaacaacaaaaaaacaaagtcactgggggcagatctgtttctaaaattcaggatttctcagaattcagaatggtgctgtgatacatatagtacccattacataacacccccagcagagcctggggcagcaccttggaatcaagcacattaataccttttcagggaaacatgaatgttcatattaagttagataaataaagaatacaaatagtttcatgcagatgaaaacactcatggttttcaggctttttctagacttcagaataatggattgtagtcctatatttataacccaaagtccaatgcagtgggcttatgtctaaaaggggtcaagggttcagtgtgttcattagaaggcatgaggctcttttgtcagccttctcttcctttcccttttcctagcatccccctccccaaggtatttccaaacaatgtatttcaagcttacattctaccatcttttcatcaatcaaaccacaaagggcctgaaatgagggactggaaaagtcataggtaaggaaggaagagtgacggcaaactgacttatccattagacgttagacgaaatagccctgattcacccagcagaaggaggagggtgctctgtttctttatggaaaagcaggaggagttgaatatttacacagtgcttaccacagctaagcctttaaatatatggtttcatttcatcctctcagtaaatcttaggaggtaagtgctactgttatcccccattttacctatgaggacacagagacttagtaagccaggaagtggcaaaactgggattccaacctatcctgtgttgataccagagcccacactcttaatttgtttaacttggtataaataaagtcatgtacattgagtgttactcaaacctaattttctcagttacaagcaccaaataggaaggaaaggggttatacgttttgttttgttttcatttttgcttggcatgagcagaacaggaaggtatagtgttggggtgcagggagaggtctaggggacatacactgtttttcaagcctgcatcagttgagatatcatgtgtattggcaaagcttatgcacacagaggtccaggcaggtgaccaagctactgtgaagtgaatcttttgtttgggcacacaatgctacccctgcagggatttctgaagctcgctccagagcgtcatggccattgcctgtcagagctctacctcatgcctagaagcagctgctgcttcttcaaaggagtccaggctcagctgatatctaatctcagaataatacatgacactgtccccccctgcccgactcagaatccaaggggaaaataatgagatcctctaggttcccccaagactcacttcccaggcttgcactatttccttttctgcagcctcctactgcctagacttggaggactggtttcagtcagaataatccccgcctcccacctccacccccatgtgcttaaaagcaagctctcagagttcatgacaagtacagagagatggagggtaatggaataggcgggatgcttgatttttcttgcagaatcccatgcttgtgtgggcaagatgaatctgcaagcacacactggattattctaggtgccaatttaggaagagaacatccaagtttgccatgagcaaaggcagagcaagggctacatgctctcctgaaagcagatcccagaattccagggcagggagtgaaaaatgcctccaaggcttgacttcctgcctacctgcatcagagttcagggcaccttgatgcagacctaaagcagtgctagttccattttttttcccacccaccagaaggccagggctaagcctccttagtacaacccatagactttatgttcaacaaaaggagaaacttcaggaactgatatagcccaaatgtgcaagcattcccaaagagcatctggttacctccaagggaaaaagaaatgcaagcaggcatgaaccacgtcacctgccagacaattcccatgtggctaacgtcaaacattctttcagagtgactggtttgaagagagatgtctgcaaggacaaggaaaagcttttcatatgcagccacctctctgctccagttactctagtagtgccttaatgtcagcccaggtagtcatgcctctgggataagtaggtacatagaaggcactaataaatctcagattttctaacaaactcgagagatggatttactccattgtttttttgtggctcatcttcccctagttcaaataaaaaaaaggaatgtgcagaacaataaagattctattcatattttttgccttgtctttgatctagttggaatctgtgtttcaatactgaatgggaaatgaatgcctttggaatttcagtcttcctgttcaaatttatttcccatcatgcccttcaggagccctcacagaggtttccttatcctctcttctgcctctttggtgaggcctttgcttccctccctcctaggtcaggctctccagcagtccctccaaccaagcccacctggccctatcttgcctattaagttggtttttacacctgtgggcctggctacctagcctgaacccaacccaatacttctggtttcactgagcggtgaccaacctacttccatccccagtttgttccagtttagtacctcctgggtcacactttaggcataatcccttctctaacagcagccactgcaagctgaatgtttggtctacatgtttattacaggctatccatgcattcagcagctatttactgaggggctgctatggactaggcatatcaaaacaacatggtgatgaaaaaataatgtccttgtgatcaaggagctcatgatctagtatatctgtgcttctcacactggaatgtgcacagagaccacctagggaaattgttaaaatgcagaatttgtttcagcaatatgatctcaggcagaggccaaagttctgcatttttaacaatttcccaggtaatgctgatgcaaatcatgcctgaagtacaacgtagtaagaaagcggttggggagatagggtgttcacaggggtacctctaacttagtccctgatattacagctgagacccaaaggatgaataggagttgtctagaaagagatgagtttgttctgtgtggagaaataagacgtggtagaggccaaaggtaaaacaaagtaaaaatgttgagtttccattcattgcggtccaaagcctaaacagaaggaagttattttaggataatttattgacatgacttattgccagggaagatggccactcaacaaaggtgatagctgcagggcatatctaaaatggctggatggcaggtgccatggctcccagctctgccaaagatgcctgtgctctaagattagcacaaatgctgcatgctcaaggggaccatgtgggctggaacaatggtaacccatgtagataagggactgggtgggttgctttgtattttggcactgagttaagtcctggaagctttaccaaagtctgaggaagggtacaaagcctgaataatgtctaagctggctttcccaccacctggtggaacagggactatactcagatatgttaaactaaggaaaataaacatgacattctgatcaccctcaaattttggttcttgactcatacatactttagaaattcaaaatggttcaatctatatgtaacccccataagtctttaggagacaccctgattttaggtcagtgctacaaatgacatgacataaagggaaaggcccagagttaaacttctagagcttctcataaatcgtaggaacaccctattacacccacttcaactaagaggtcttggttggctttacaactctcaataatgctctaagatgaaccacttggaaagcccaatgaaatatggccatcaaaacaaaccagccagctgcatagccccacatggaaaagtgtgatatttggaaatatctccatcagggaggtagtatatgcagaatgagcaataatagtgtctcacacagacaacagctgaaatctgatctcagaagtcatagaaaggaaaagaaaggggacaaaaccatcctaaaaatattctaatcacactcagagcaattcaaaatgataaatagctaagagaaaaatagattctaaaacaattaaacagaggaaacaaacagagaaactagaactaagacaatggctcattgtcttactgtgtcttagttcactgtgtcagttagtggcaggaggaggaagctgggctgggcactggagactgagaatctgggaaaaggagtactcagatggatgctgtggctgttgcatagacggagagcttgggccagcccaccagtggtgctggtggaagattgcctagtttcaaagttaccattcaaggtcacgaacttggaagttccataatactgagtttcaaggttgcccctcaaaggataagcactatcaccaggtaaaagcacagatggtgtctctaatggttactctgaaactaggtatcagagaggaggagcaaggatgtgctgagggttagaagatctaagttagtgtctgaggcagacagatcagtgcctgcagctcaggagcgaatgcaacgaagttctatggaggccctttgctccaacagagttccctgatggtctgctgagggtgccacttgccttctaagggcttcccagagctgttgcttaaacatttcaccctgtctgatcaatctctctggatttaaggtgacatcactactccttgacctggtactttcattctccacatcctctgccaggcacacctttttagtacaattagggaagcttagaggaactgctgaggccacaagggattggcaaccgagccccaggcttttctttcctgtgctgcagggatggtgctctccggcagcctctcatggtctttgattcatttctgactcccacaaagaggaaagcaggccccaaaggcaatcataagtggcaagtgctatggagccatggttttcaaattgtgctcctcaaagctttagggttctgcttcctgagcaaaggaagctacctcatcttggaggaccaggcggggagggtaggagtgcggactctgagcctttcacccactactgcagccaacgcagaaccaattttacttatttcatttaaggttctaagtcttttttttgtttgaaaaatataaaaaggtttgaaaccactaaaatagtgtgtctgcatcaataacatcacaccatattttttatagttaactgaaaagttaaagccaaggtaaaagaagaattcgtccaggcggaattcaaaggagatgaaaaattcctaaaacaggtcatcgtgaaacacaaaagctcatttggccactcatctggattcttagtgaggattttattggtggttattttaaagtattttctgtgaaagtaggcgcaacaactcctggttcttaccaccgtgacattaaccttctaaaccctcccgttcagatcattaaccccatgggattctgttccacagtttgttaagctgccatcctgcctgcttgggaaaaaaaaaaaaaaatcccagtcaaagatcagatttcacctgagactttaaagccccaagaatttggccaatgctaatttagacattttttaaaacaggttcctccacttgtaaatgactgcgattttgtgcagagttagaaaaaatgccttctgtattgggaaaaattcaattattttaaagataaattctcattttaaaaatgattttctacccttaaaacagtattctttatattctcaaaggaggagaagctagatcaccctacaatttaaaaataaataaacctcatgaattgtatccaaagaaacaaaagttaaacaaacatattcctcacttaactagagatgtaacatgtggttttattttagttgttaaagctaactcctgatctccttccaaacaggcctagtgacttaattaccatatttgaaaggagagccacgaaaaaaatggagacagggaaggagacagatgaatcttcttggatatttcttcacaagattcagagggagtccaatcccacaaaaaggacagccttaggcatcttctagaaagacaaagcctttcttgggagggagagcttgaccttaagtggcagcaagaatcaactactatggagataacatgaggaccagtgatgtaaatattccttgagaccaaggtacaacactgatgactgacagccacagaactctgtgtctccactctatcttctttcaggtccccttccagtctgcttttaaagttgtggagtcaggtgactggggatgtgtgaagctgggaacttctgggattctgaaatgcaaaacactggaggcagtcccagagaagaagagaaagaacattcttttccaaatgacacaagcagacttaagtaaatttatttgttcagaaaaggtcagtaaagtcatgcttttcccattaaaaattgtatacaactgatcaacatgacggataaacacaactctgtgtagcaagagacccaaggcatgttacaaactcccccaacacctctagcatatgctggaataaatgaatattggcctgggaagaaaagtaactttagaaacagtccaacatccattaggcagtgtgcttcacagaagcaaaagacatcagacgatcaactaccatgttcagaaaaataaaccagaaacttgcactgctaaataaaagtttaattaaagggaagaaggctatctattattaaaatggtcacagaaaagagtagtagatccaaggtttcacttccagtcatttccataaaacctattttgatcattcaaccagatagaagctccctcttcttttacaattctgtaagatttcttttttttttctctatgtgctgaatttctttccctgtgttgtagaggcagtaataattcaatcacagggttattgccatttgagatactggaataatctgcaaatgtaaaagttctattcagtattgtcatagtagtaaagcttttatttttagtagtctcttttcactttgagatagtaacctcaaggacaggaagtactttttgcttttctttctatgccctgcaatgccttatctcatgcccagcacatggtaggttttccgcaagtctcttttgaatggaactgcatctctgccaggtttgcacaccgctgatccttatcttccctcagaacaggtactgtcattgacaatccttttccataatagaacgttagtatttgagaggatcctggaagttgtctagtctcatcctttcctgcccaaaaatagtactggaaaaatgcagagatcctgactttgaaataatggtgggattccattctgggctatgcattttaatcagtgttaatgcataaccaggaagttcttactccacctgcttaatttcataccctcttgaacagaaaaatggggcattaaaggaatgctccaaggatgacatgaaaagaagaggagaaaggaagctgttttccatctttgctaaaagcacaaaaatattccccaattacatggaattctctattcatctgagagacagactgatgttagaaaatagattcaggaatacccttttctcttgagaatattatcttttctttaagaaaatcaacatctttatttcaggaactatttttttttttctaaatgagatttgctgattttctttttgcagcatgactttttttattcaaatatgaagatacatatttgatataaatttagtaccggctcaaaaagagatattaaattcagggctttgtaaacattatctcatttatgtatgatagtaatgattttttatatatgtatgtttttattatactttaatataataattttaaatcagaaattactccagtccctatctccccttttctagctctgaacacattttccacctatgtctgcaccatgctacagccattagcttcacccatcttaagcagtaagatgattttaaactgagaagcagccatgaattaagccacatagaggtgaaactgctgtcagatgtttagtagatttgagggtgcaaacttaatcatttactgtcacagaaatcagaaatgcaaaaaaatctttgagataaaccaacctcatgccttctaccttaaaaagagaattctctgccttcttcatggggccaaggatatcaaatgagcctacaaagctccatctccaccctccagttaatcaaatctgaaaaaattcctggaagagaagcagcgaagggaggttgcactgtgaattgtcaaggcctttagaattcctgtgatttatagatgagaatgaagcctttccatgcatattgaaggtgcatgggattcttaatttatggcttaggagttgcaggctacagtaataaacctgctaaactactgaatcactgccaagagtgacctttacagagcctgcagaggtcaagcagccttctccttgcgagtcaaagaattcttggctaaatcaaagctcttttggtttaagaaaagagaaaaccacttgagccaacagaagcaaacataagcaatttgataaaaggaaacaagagcaggaggtggagcccagcatcatgagggaatggaaatagaactaaaaaatccagactcagggtatttgctcacctctgtgaagatgcatggtagcctcatgtcttcttactacttctgcagactgacattcctggctttgtaatttggaatcagagatgttgattagatactgatgtagattagaatacccctcggaggacaaatgctgccttacaagtgtttttgctcatctgggctgtctgctgaccctcttgtgttgacctacaatatacttgtctttcctgcccttgtcttacttaatctttcaaccccctcctcttggcagcatctctttcctctgctcatgaataccagtctccactgtgttttctcttaactctctgacttctcctcaaactcctttaccaacaattcccctttctccacccaccattaaatgtggtgtgcctcaaagctctgtcctaggccttttctttctatgctttaacccacaagtgctcttagccacacccatgacttcagctgccatttatacggcccagccaagacctttttttctgaatcccaggcctatatatccacctgcttggtccatatacctacttgaatatctcagaggcacctcaaacccaactcatccaaacttcccaccctcaagaactcctcctccaagattctcaatctcagtaaatggctctactcccctgctcaagccggaaatttagggcttacctttactcctcctgctccctgctctacccctcacacatttcctcagcttgtcctcctaaacctctccaatcaacccaactctttccacacttgagttgaggctctcatcatctcttatctgggccactgcaaagggctctcagttggtgctggggctcaggaaaaaccaccccaaaacatgactgtaggagaacataatacaccactctaaaatatgtctcttggcatgttgactatttcaaactgattattttgaaaaactgtagacacaggcagagctctgaaaagtcactcttgtaagagaaatgtacatctaaaggaaaataccatttgtaaggtgtttctctctctctctctctctctctctctctctctctctttctctccccaccagggagaaagggatggttaaatgaggagggagggaaggcctagactaaaatctgcataatcttacccttgttttctcttttcctggccattttcccataaccagagtttccccacactccttttttaatttgtttcagcaaactatggcacaaacctgaggtttaaactatttttctttgagctctgctggagaaatgtattcatttctctggggttttccccatgtgtacataaagtatacatgtttataaacttcttttgttttcttttgtgtgtgtatgtgtgtgttttctcaggaagttccatttaagagctatgaaaggtagagtagagagaaaaattattttttctccatgacactgggcatccatccttgcccctccccagtctgtggccagagcaattcttttaacattcaagtcttaacatgtcactcatctgccttcagaggcttcctataaccctagaataaagaacagagttcttttatttatttgtttgtttatttatttatttttgagaaggagtttcactcttatctcccaggctggagtgcagtggcgctatctctactcactgccacctccacctcctgagttcaagtgattcttctgcctcagcctccccagtagctgaaattacaggcacccactaccgtgcccagctaatttttgtattttttagtagagacagggtttcaccatgttggccaggctggtcttgaactcctgacctcaagtgatccacctgacttggcctcccaaagtgctgggattaaaggtgtgagccaccatacccagccaagaccagagttctttctaagacttccaaggccctgctccctctgtgacttcctcacatgtcactccagcctcactcattgcacagtactcacactttccttcttttagtccttcagggatgcctcagttttctcacgtcaggacctttgtagctgttgttctaccccgctacccagaccccgtaccaccatcctatcctttctaccttgctgagtcccatttacccttctggtctcacctaaagtatcatttctaaggggctcctattagagactttgtgtatgtttggtaatatttgtatgtgagcttgtactttgtatattggcacactgcattttcctctgttaaacttttcacacttgtaattatttctttcacttgttcattcatcaacttatacaaagcactttcatgtgcctggcactatctaggcactgggttgcaacactgagtggaagagattcctacactcatggagcttccatcctctgtaggtcttactctactatttgcttttaagttcatgaggacaaggtcatgcacgttttgtttcccactgtgttccagtgtttcgcacattagctcactgtctggcatgtgtgaaacagtcaacaaatatttgctgactgtctgattggcctcccgaagttactactgtactgttgggtacatagtaagtaaatacaagttgaattagacaactgcttgcaggcaattgtgtccacagaaaatggcaatgcttcagacttgttatgatgatttgcattttatttgactttttagtaaggaattattgatcttcttatctctgttatgattaatataaatgaataaatatacatgacaaacaacttcagagtgaaaataatattaaggaaattaggcgggttatctaatagaaacagaagggatctaggtcacattatattggatggttagaggagtcctcccaaaggaaggagaaatttgagcggggatctgaatatgaagaaagagcagccagctatgcaaaaatccagggccaagctttccagacacaaggaacagaacgcgcaaaggctcggggaaagggagtagggggaagagctgggagtggggggaagacctgggggtggggggagtgtgttttgagaagcataaaaaagcctagggtggctgaagtccagcaggcaaggggaaatcctgaaagaggagatggcaaaagtagccaggggcctcctcacaaagggtccagtaggccaaggtaaggatttaagattttattctggttgtagtgggaagatactgcactttagaaagtagatagttaatatgatctatgttttttaagaaaataaattatttgctctgtgggaaatgggctacagttgtgcccttcttggcattaagacctcttagaatctcagagaccactagaggaaaaagtaaaatagttctaatgttctaaactctgacctatttgggactattatataattataaaggtattcattgaatttcgtcctttttggtaattttcaagtcctactaatgacaactttcctatctttattggacattgtgctaatcaaggggccatagctctgttagcacatttatttatttataagcaatccatttattactggtcattgatgaatatgacgaatataatctagctgatggacattaaaaaaatccaaaaagggaacagctgataaatgtctcccttcaactgctacaaagtgtgcaacactgtcaccagagccctccttttgaaactcactgatgcattttacatttgtcaaattcattatttatgagcagtgagctatacaatagaagcgagagtcatccacagggacacatctgcctgccttatatttgacagggcttatctccaagggaagagggcttcagttttttatcatgtcagttaaaaaatgtactgatgtgtttttaggctggaaacttcttcttaaagcatgagataatgactttgctaaatcctattcaaaacaaagacacacccaaaagctatgaaagcatagaaaccacattgctatttctcaaatgaaggagaaagactgctggactagatgaaaaggggcctcttgttaaggcttcccatgcaaatatgccaggatgcatttttccttctcatatttactaacaccacgaagacattgtggtacgaaccagtttaccttttagaagctggattcacagatggcagtaacagtaactataaatagccaagagcactgagaaatcttttaaggaaggtcatcgtcaccctaccgtatactactgcttcagcatgggcaaaggagcagagagttaaccttagagaaagctctaacagtaaattcagggcactagcagctggaaggtaactggattcaaagccctgttcctacccaggtctgggagctcttacttgctccttgttgaaattaccgtgcccagtctgagattgtgacaggcttcagaactgctactgctgaattggtggtaggaggtccccttcagctgaaggaggctcaggacccctgatacagccaagaggatgaggcaggtgcctgaaggagacctagcagatgggcaaagtgctggggcaagaggaccttgtaggtctatttattgggtaattttaacagttcactttgataatgtctccttgccagtttgttataaaggctacaatacttcatgtgaaaaacctgagctccagttttggtcatatttgttaaaggacattcctcaaagggcagctgctggatagcaccgttgggaggacaaggagctgcaagagatgaaacgtacacttgcggcgcctgaaataacatgaagtccaatcagccccgtgagtcgctgtagactgataagggcagccagattccacagccatttaaagagtcaacatgttttagggctaaaaaacttcatgggccccaaagtgtcaactccttgaggggtgactgagaaaccatggccgaaaagtccacctcagcagcaagtccaggaacctaccactgaccttacctgttgaaagagacttagggcctctggggtctttacttctgggagcctcaacggtttattgatatgtgtagcttctactatgggagaaaaacacaacagctcctttgcagaaatatggtacttacaatattattagcaataatattagtgaatatttattgaacattttctacacgcaaagtcccatgcattatcctattaagaccttacagcaacctgaagacctaggtttcctgaggttacaggggaggaaacaaggttaacagactgaggagtaaagaggaaaggcaaacagaatctacctttatatactggactggaaattaaatgttacagacattgaattatattggtctgctcatttcttaattgtgaaactacaaggctagttgtcatactctaataatcatttatttttttcctccttctcttcctagccggtgagacttttatctttaaaagacataccatacatacatacacacatacatatacacactcaacattcaccataaacacaaattattgaaccatctcatctgtcttaccttattatgggaggtttttaccattggcacaaatctttttagtttcagcagaccatgagtcaaattccaagtattcaagacacaatgagaaagtagcaaagccatgacttgaaatctctttatttcatccatgcaggatttcttctgcagggacctcatgctttggtgtcacagagaagcaaaaccttttgcttcttcaaattatccttttactttttccccctctcatgctgtctttgaatatattcatgtttgtgttttatgcaaaggtatgcatatatgtgcccagaatactcctatcacagatgtctctggcatagcaaaaaaaatggaatggagccagaaagacctactatggacctttataagctgtgacctgtgcaacatttgtaacctctccgaggctcagttccctcattgggaaaacaggcaaaaggctgttttgcctgtcatgctttgggggtgggcccggtggtggggggtaaggctgttgtgagaggtaaggtagcaatgtaaagcacctagttaacctacagtggagagaaaatggtagacatcattattacagtaactgtctaaaacaaaatctagatatgacaaaacctggttagcaaggcaggtgtaagattggtctcaccctagcagtaaaacacatttcatgtagcataagatgttctataaatcccattcagaaatgagtctgtccacagtgggcaatacatatctgcccatctgcaggttgaagcaatgtggccatgtctctttaatgctgactgatgttcaactacatcacagtgcccttgtcatggggctcagttaatgctgaattcaattatctatgtagatggaaagagcagagtcatagataataattctgagaacaaatactttctaaatgattccttcttttttttttttttccataatagctaccttactgtattacttgggtcttggctgatgtttggtactctataagaatacgtatcaatggatgatgggaagaaattcatgactactctgacctggatattatagaaagctctcctgagcctgaatatttgttgcataaaatttgcaaggtgaataactggtggtggtccaccactctctaatgtatggcacaataattataaaatattcattcaattttaagatattttctgtgtgtgtatcaagtcccaccagttacgcatctagtctgaattagctcattaggttagggtgaacatagtgctaaggaaatcagaagattcattttttttttaaagatcaattagcatctttcctttggtgctcccaaaaactctgtgataaggagaccacataactgtgaatactgatgtgaaatgccatcagtactggtgggtaaataccataaagcagcggtcctcaacctttttggcaccaaggatcagttttgtggaagacaatttttccacagcagggttagggttggtttcaggatgaaactgttccacctcagatcgtcaggcattagttagagtctcataaggagtgagcaatctagatccctcacatgtgcagttcacaatagggtccgtgctcccatgagaatctaacaccgccactgacctgacaggaggctgagatcaagcagtaattctccattactggccactcacctcctgctgtgcggcctgattcatgacttccaccaacaaatgtaatgtcttttctaccgtaactaagcacttaccatgcactgtggccataacttttgcagtttgagaggcaacaagaaaattagcataaatttctttttacttcacaatttcacaggcagaagattcataccatagatctgagcaaccttagcctacaatttttttctttccttaagtccttatgttcaccttttcacttaaaggaagcactttatggcttctctttggcatatctgaattgctggcatcactactcttgcactttggagccatcattaaggaaaataagggttccttgaacacaagctctgtgatactgcaaaggttaactgataacccagatatctactaaatgagcaatgggcaggtagagtctacagtgtgggtatgctggacaaagggaaggttcttgtcccaggtaggacagagcaagatttcatcatgctactcagaacagtgtgcaatttaaaacttatgaatcatttatttctggaattttccatttaatattttcagaccacagttgaccacaggtgactgaaacagaggaaatcagaaccatagataaagggggactactatattgtgaaattcgtaatgcaattgtcgcttgtcttgtttcaaccaacatagtctagtgcctactaggtacaaaggactccctccccaccccagcagtgttctcagtgttgtatggatccctaaggaccctttcaaaggtacacaaaatcctcccctttccaaccacatactcatgtcagccctgacatgaatcaaaacaataaaccacaatagactgaaaatgcagaagcggatatgagtccagttgccttctgttaaaccagacgttaaagagatttgtgaagagtaaaacaatattactctctttactcaaaaatttttttgttttgggaaatgtagttatttttcataaaaaaagttattttgttagcatgtaatgggcttattactttctcaattaataaatatttttaaattttcctagttttaatttctaatattgttagctgttgctagatatgacccacatacacaaaagatcaggattttcagtaatttttaagaatatgaaggggttctgaaaccacagaaaatttgaggagcactgactgttgttcatctgtcttatttaaatcttacagcatcctaattccgttttcctactttaattgtcttcatagaacttatccttatctgacattatgtcatatatttatttgcgttttatctgttttctccataagccagttatttgcctacttgctctcagatccgttctctatctttcctcagcaaaacgtgtttcccaggctcctttgccaaagacagtgggaagcattggcaggagactggaggagggaagcagacagccaggtatttctacctcccaccctgccctttcgggtcaggcagtactgctattcaccttggctccaagggacctcccctctttgcccctggctcctgagccctggtaacaccctctctgacttccctcatgcaagcctaaggtggcagtggcttccggctcttgttataatattatattgttgctttgccagcccagtttgactttgagctctctcagcacttttgtgctagttctccacgttagctcctttcattgcaccatctggcatggggcctgttttcctgactgaaatgtaagttccatgaggtctgggcctgtctcatctgctaccataaccacaatgtctcaagtaaataattttttcaaagtaacagccctgtgggataagtgttagtatcattattttatatatctgaaaaataaggctcaggcagaatttgctcgccccagacaagtgggtctcaaactctagcttgaatcagaattacctacagagctttaaaacacagatttctgggccacttccagaatttttgattcactaaatatagggtgaagcctataactgcatttctaataagttcccaagggatcctgatgctgctggtctaggacccactttgagaactactgccctgcgtgacacaactgaaaagcagcagggccagtccttatgtctagtcttcccactgcatcttgaagcttaagggtatttgacaccaagctcaacagtcaggaacgtgccaccaaatatacatcaactctcccaatagctcactctgggactgtagtccagatctctattacattattcatcctgtactctattatttgtagtctataccacactgaaagtaacaagtttttaagtttccaaacatacataaacgatttcttcctttcttttactggtctatcactgaaccttctcaaactgcgaaaggtattcttaaatatcaggatttagttggggaaaatacccaaccatatttgccatcttccctttatgattttacagcttttcactttttccctcttcctgaagaattcaagttagtccaatcaggaacccctacttttcaatttcttaatcatcttagagaccataccctggaccgtcttctattctcatacacccaccttgagttgccccaagggctgggcactctgatttcaagactcaccatcagggttttgataagaaggtaacattttggtttggttttagcatacttcctgatcatgccccaatagctttattagccctggtagttgttagacttcagaaaaccaatgtacacatgactggccttctccttgggctgtcaataattatcctttcagaacagtgaagagcatgaatggcatatgtatgatacacattctttagtcttgcacctatgcagatatcataatcaaccacagcatgttctctctgagccccatctaagaacattatatggcataatatttcaagagcacaaggccatggcagatgttctgcacctcctgtgacattccagtaaatggaaacctctgcctttgcaacccctgtcctctgggaaaagaaagaaagagagagagagaaagaagaaggaaagaaggaaggaaggaaggaaagaaggaaggaaagaaagaaagaaagaaaaagaaagaaagaaagaaaaagaaaggagggagggagggaaggaaggaaggaaggaaggaaggaaggagggagggagggagggagggaaggaaggaaggaagaaaggaaggaagaaaggaaggaaggaaggaaaagataaaataccccacatcaacctgctttcttccacctcttcagatgtcatttgtaaatggagctcgggtattagaagggaaggcagtaaattttttcaagttaatcataaagatatcttcacaagtacatctgtactttaaataggtacatatatgaaaaagtgggcctaaatttttctacttgaaaagaaatactttatcccaatttaatctttatcatttccagaaaacagggaattatagacactactttcatcttgtttttaagttattatgtttttagagagaggaaaggttataatttcatcaaatgcagcttaaaaaactctgtagctttgtagttaggcaagtctggattctaaacctggatcaaccacttactaggagggtgactttgaaagaagaaatttatctcagtttcctcatttgaaaatagggataataataatgatggttaaccaggactgctgtgaggattagaaaaaatataataaaagacctagcatattgcttggcccagaataagtaataaatgctagttaatataattattactgtattttaagctttggaattaccaccttattttaaaagtggaatgtatcactcttagttggtattcaaattttgatcaactgatattctaatggatgtaaaaaattatttcttttctgagatcactggaactgtgacatgatcaatagcgtctctccattttttcttcagctggtaaataaatgtgcaaaggtactgaaggcaaaattctcctatgtaatcaagcagtaaaagctgtaataaatcagaggtttttcctttttatatcactttgaaaagggaaattatgctaaaattttttcagcatttaattctctaccaggaacatcctaagcactttatgtgcattacgtcacttaattctgataaccttacaaagcaggtattattatttttcccacgtcaccttctagatggggaggtagtctcagagaagttcagggtttgccaagcttacatagggagagcttacgtaaggagaggagcagatttaaatcagaactgaagatgagctctgggactttacactatttctggaaaacagaaaaaagccagcagccatcccatgtgccttgacagctactgcccacaggtagtttctagcgactctggtacctcgttgacacatttgctcacatttctcttcaaaaacatgggaagacaaatgcccctggctgcaggctttttcttttccactttgagatgccaaatatggatggcttatctgagggccataataggtaagtccgcaatatttagcaacttcttttcttcctgttaactgtagtagaattcccaggctgggtcaagcaatcaaggaggtattgaagagagtgatccacaagtaattctcagtggtccccagacactgaggccccactgtgctgtcacatcaggcattagggtaatcttcagctgcaccagagactaagcaggagcctcccattgccggcggattgtcaagggatatgatccagggggtgggcaacacaatgaacacctgactcttggctgcagcttctcccttaattcttcgctgctctccagtcctgacgacctgggctggatgatgtagaaacatcaaaagcctattgctgcttttgaataatggttatttcttttcctgagaaagaactaacaactctggctccagtctctgtgacgacgaatgttttaatcacaaaaggcctgaactaaggttcagttagacacatcactaaggagatattcacataataaaaggcctcttcgccaagttttgtttaaatattgaactctcagagaaatgaagatgttagccaagtgacaaaaaattcaactgcctcccaatttttgggaatacatctttttttttaatatgaactatgtggcatccttcaattcatttacacttgcactacagtagtagttcaccacgtgtctactttataccgaatgttatgctgggtgctgcatcctgcagcagaaagaagatggaactggctttgtgcaggccacttgtgctatgcctgtgaaatgccttctaaagttctattagagactccttcctgattctagctgtcaaggccaagcaacgccaatctcatcccatgaatgtctacctttcctttcatttgttccccaagctatagcaaaagatgaagggaacatggatgatcaactccacagccaaatgcttgagataattatggacttttgatccttagttctttctaaccttgatttacctgatgagtctattgtatcacactgaggctgtgatactgagggaactaacgtttaaagcttactgctctatgtcctagcattgtgtcaggggcttcacacgtagcatgttattttatattcttaacaattccatgaagcaggtacctgtatatgcattttacagatgagaagacaggctcagagagactaaaattatgctagtaaaatcatcatcagaattcaaactcaggtctaacagaaactaacacttctgttccttttaactactccatccccttcccaaactagctagtcttcctagagcatcccatttattaaggggaaaatatgattatgtgaaagaaaatatggacagaattattcactagaataggaaattagcatgaattttttttttaagatataacacccaaaggtcctgtctgcagagacctttgcagataacacacgtccttatgcctacaaaggttcgttgaaggaaaagcttgtgaatcactttccacacatgggggtgtaaggcaggctaataatttggccttctggcaaaatgacatcatataagtatctgcatactctctatctagaggcaaggcagggcactggtggggagggcagaaagaagccctctggtgtcagggccctgctgatacaccccttaaagcttgacacttagacagcctgcctctccaagctctactgacctccacagtacaggcttcgttgactaaggaaggatgccatggctacaaatgacaaatgacgaatggaataaaagcagcagatgcccccatccccaccctattatggcctttgtttgtaatctctggcttccactgaatatcacatatcccatttcccttcccagctggtgctgagatgtaacaacttgtcacctgagatacagcccattaaaattacatagcacaggtaatggagaatccagtgcaggtccggacagcaggtaattagctgtaacttacagagcagtcttcaggccctctaagggcctcctgcctttactccccttcctttctgcttctttgcacactggaggccctaaacagaggtatctcttgggatttgttgagcaggggtggttatttaacactgttctcattaattcagccaccaagtcattgcagtattgggttcacaaggttgtggtggggaactgtgaccatcataatagaccatcaattctccagcagccagtggggtgcagggagtggattcagctgtctctgcatgttttccaagaatagacaactgaataaacttgggtagcatcagaatctacaggaggcaagttctttaaaggaacagaatcttagagttcctaccagtaagggcccagtagagtttgcatcaggtgcagggccctgggttttttcaagtccctctctgtggtggttttgtctcaaggcatcccttcgagaggatttaacatgtactgcaacaggcagggcaagccaagagtgatgttgactctggggtaagaacaccacagacatgagatgttggagtcattgacagcatgggctttggagttgagacaccttgggtctgaaactcagttctgcctgtgtgaccctggcaagttacttaatccttttgagtcttagttttctcatctgtgaaatggaaattatactacctgccttacagggttattttacagattaaatgacataatgcaggtgtattagtctgttttcattctgctgataaagacatccccgagtgggtaacttataaagaaaaagaggtttaatggacttacagttccacatggctgggaaggcctcacaatcatggtggaaagcaaaaggcacgtcttacttggcagcagacaagagagaatgagaaccaagtgaaaggggtttccccttgtaaaaccatcagatcttgtgagacttattcactacccatgagaacagtatgggggaaagtggccccatgattcaattatctcccactgggtccctcccaccatgcgtgggaattatgggagctacaattcaagatgagatttggggtgggacacagccaaaacatgtcagcagatgaagtgtttaaggtagcaagcattcagaaaatggcagctttattcatatgccttcccaactggtaaattcttaggaagccaaacagtttactagatcccacaggtggattgaatttccagagtcttggaaaaacttgccagtgcatgaggctattatgggggctctgttattgcagtgagtactctgcaaacacttttcccatcctcttgaaggatcaaatgtaggtaaccttgcccaacgttattttaatgagtagcttatcccagatgtgactaataggctatctccccaattctcctgctaacccattcctaccctctgctgaggttagctggtttgacactggacatgaacaggtttagtattcagtcttctggaaatcaagtgagaagacacttcctagtagatgtctctctagagttagatgctcatctgtgaagccaggagcctaaagaaatactggaattttccaaaggctctgagagatgtcaacctgaagtatttataaccctcatcacagagtgattcagcaatgaagactgatgatttttaaaaatcttgtcaagtcttttaaagcacattttattttactgaggatacggttcaaaaattgtctaatagtctccaagagttttggttggcagttaaaaagaaatgtatactgagagagagataactaacatgtatttttcagcaactcttatgtctcaggctctgggatgggtgtttttattcatactgcttcatttaatccttacaacagtcctgtggaggtcacagttataacccttagtttacaaacgaatggaaacttagagataaagtcacacagcagcttctaagtgacagagctaattgattaagcccaagtctatctacaagtccagtactaattccaacatactgtaaatatattttgttgatgcccattctgtcttgctagcgttacaaagatttctatcaaaataaaaaccatgtgagagacatacaatagaaaataaaaacttggctgggagatgtcgctcattatctgtaatcccagcactttgggaggccaaggcaggcagatcacctgagatcaggagttcgagaccagcctggccaagatggcaaaaccccaactctactaaaaaaatataaaaatcaaccaggtgtggtggcaggtgcctgtgaccccagctactcaggggactgagacaggagaatcacttgaacctgggaagcggaggctgcagtgagccgagatcatgccattgcactccagcctgggcaacagagcgagactctgtctcaaaaattaaaaaaaaaaaaaaaaaaacttaaaatgtaaaggccaatcataaactcaactccccaacatcccatgtctgagaagattatccctatggttgacttgtttttatattttcagatcccttgccacagcatgtgagggaggatgagactcagctgtagtctcatcggaaaggttaccaaagggatgcaactatttccacaatgcacttgaccactgaacagactacttactttagaaatatgtacagaatcaatttagagcaactagacattctggacattatgtaaactgctcaagaacaggggttctgcctgctttgttctctcttggaacctaaaataggtgctcagcaaacactcattgaaagaataaattaataataaatggcattaccagggagttatgggccagcagagggttttcatgaggctaagtaatctgctgcccagtcttagaatggaatgaaggaatatttacagtacctggacacagtcctcaggcatttcagagatgattaagaaataataataatcaaaaaaaagaatcctttatctaaaagttctagccaaaaaaacaaaaacaaaaacaaaacaggtcttataaaattttctccatcctaaacaacctcctaaaaccattcattgaaaagcctttaccatgtgaaggggaatctgtgaaataataatacatgctatgaatggcagcataggacaaaggcacagatttctggccagacactcatgagctcagaccctgactcctaaatatgtattagctgtacaacctaaggaaagcccttcttcagcttgtttaaatgtcagcatcttcactggtaaaatgagatattaacttcatttttactttattgggttgtaagaattaagaaacattaacagtagcaggcacagggcttggtatttagcaggctcaatagatgtgaattccctccctcagttccctcccttgctttctttgttctttcctgccctgacacccacttattctaaaaccccagaggtaagtgagatcatgtaattgttttatacatgttcttattccttcttttcaaagacttaaaaaacccatgagttggaggacctctaagtttgctactggcttttttctatcaggtctaaaatattaaatcctattatataacagaaaaacagggaagctgggggatggaccataaaaattactgtaattagtcaggcaatagaatttttttttaagtcatggctttctattttactgtcttggctgtgatgtctaaaaatggttaaagaaatataattgaaaaggaggtggcccttgcttcagaatttactgctctttcaagggctttcacagggacatctgttgggtttgtaataaaagaagccagaaaaggtttcaagagagagtaagggaaactatggtttacaaggtatccacatctgtttggtattctgccatctgagaaagttcgacttctgaaatagcacgggtcacctagttaagactgaatctaggaacagatgaaagctttctttcctcaatgtttcaatggtagagatcaacagctgtttatatcctttaatagctaactaaggatgaagctttcacatctgtcagtattttccggttctatttccttggatcacagtggggaggagatgaagtttgaacccctcccaattcccaagcagaaatatgcccagtattcaaagctgtaattctaagcagaactctccatttctcatccacccagggtcctgtttgcttagaattcttcttttgctttaccctgacagacatcttgattatctccatgataatgactcatgatagcacaaagatcaaaaagaagaaaagtaggctggagtcaggagaaggaaaaagaggaggaaatggagtgtaacagagaaagtagctcctaataatacgttcttccaaaagaccacaacagtagcaactgagggcaaatcacagaggtgagcaggaggttgaagactctcatagtgaaggtggacggtgatggtttttactgaccgtaacatctcaccttggaaaagttaaacagagaaaatggaaccctatggaagcaaggtgcaggaaatatccaggaatgaaaacaaaaggattcagaaacatttgtttaactttgctctgatcaccagaatcatccatgtgctgggcctttataaagattatttttccatccaaacatccatccacccacccgtccatccatccatccatccatccatccaataacttgaaagttaccaggactagagttagtgggtgatagtcagatgaattagacatattgcataatttaaagagctggtattctaatggatgaaagccttcacagaggacatggtatctgagctgaacctcaaaggatacatgagaattcactagacagagaagtgagtgattacagaaggagagaaaaacatgaataaaaccagagtggtaagaaacaaaccacttctgggggaatgaaaaattctgagtggttacaataaacagaagatgcttattaaaagtacaggttcataaagaactcaaataactcaattgaaagaaaatacataatttaaaaatgggcaaaggatctgacatatttctcaaaagaagtcatacaaatggctaacaggtatatgaatgaataaagaaaatgtggtatatatacacaatggaatactattcagccttaaaaaataaggaaatcctgtcatttgtgacatgaatgaacctggagaacataggttaagtgaaatatgcctggcacagaataacaaatactgcatagtttctctgatatttggaatcttaaaatgttgattgttgaactcatagaagtagagagttagaatggtgattaccagaagctggaggtatagagagggcgttagggagatgttggtcaaaaaatacaaaacttcagttagatagaaagcgtaaattcaagagataaattatacaatgtggtgactacagttttcctttctaaaaagtgcaggcttttaggtctcacctaagagattctgatttagttgttaatggggaagagaggttcaaggaatttgcgttttgaacagaaggcccaaataattctgatataaacaaaagtttgacaactgtaatatatacagcttaacgttttccaaaagatgctaatggtctttcattaatttaaaaaaaaaggtaccagtgtcaaataaggaaccaccacatactattcttttcttggaaattcataatgcacattggcatattaaaagtcctgtggtaaagaaatcaatttcactcagcatttcccaaacttatttttccttgggggaagaaatctttacgatctctcaaaatacaagtatgcaatggaggctagatggggtagagctgaaacagaggattctgaccaggtaagcacgttccctaagcatactgaatgactaagaaaatgtctagaaaaataaagcaaagtcggttaccctgggggatatagaggcatccatagaggcatccattaatttcttccaagcaaagcccaaaaccacctatgatgtcctgttttccagccagacagccagaaacttcctctctctcaagtaacacaccatggctttgtactatgacttctggtcagtactctctgtggtagccacagttgcagagagaacaggagtatgcagaattcaaagcatacaggtgaagacacagggggaaggacaaagaggaggtatccttgcctacatttatttatctttattgctattacatgttcagcatagagcactggcagttgctagtaaggcttctggaaaagaaaaaatccttccagctccaaaagtagcctatgacagtcaatgaaaagtgcaaaagacatgaacctaagaaatttccaccactctgaggtgcttaatattatgcccaggggagtttttgaaacctgccttcttcctcctatgctgtgaactgggggatttgccctgacatacaacctacctccttcctgttaagaaggggtaggagagagagaagtatgagggaactggacaagccaaagcaacaccaagatcctgacaaactggtttgtgtgccgaatatttcaagatgtacatactgcgtcaatcaatgtatacattttttttctggtataaacttaattacttccatacacgcccttctcaactttccaggtgctatgtggggacacatcctaccccaatctagaggtgatttcaacagtgtgtttcaaatacgttttttgtactccaaccatctcagggcttttaaatcatactttctaatagcacaagtatttattccatcattccacaaatatttcctgagtgtctacaaggtggcagggcattatgttaggcactggagctacaacagtggacataggagattgcggattcctattcagcctacggcataaaacactaaattctaaattcagtctgaaagtgcatggaaaaatctaatgaccagcatcatgaagaaatgtaagaggcagagaagactgactggtccttccttttgaagtgttttagcctgtagcacaaagcaaacaaactaatttgcatttcaagtgtcccagtgtatccagaagatacgcaagggttaaagtaaacagcacagcctggaattaacaacctatgattagaagagggaggagaatttcaggatctctttctcctcagaatttgaacccccagtttgtttgatccccaaacaaatctatgaattctcacactggaatttcttaatcctcagatataaataccagtaactgcatcagagtccatgtaactttagtcagttaaccaaaaaataataatcttatcaagataagtgagtgagtctgacatctagtcctaagaaagccaacacaatcacacctaatatttcaccaagtcagtgttccccagcatgtggtatgtgtaccactggagtccacaaaataaatgtaagtggtccataaagttttttttttcatttcaatgaggctcttatatatcactcactacaggtatgtgagtgatgggattaatgcatgggtgctacctagcattcaaaggcagtctgcaaattttcatagtgaagattgtgcaggtgacaaaaaaactgagagctggtaatgaacttacccacgcatgttggaaatatttcctcgttgttgatctgaacctcaatccaatccataagaaggttcatgtactggggagctggcagcgctgttggcttcttatacttgagatcatcctgccaccgatactcatatttggggccccctgacatcacaggacaggtccgctcggtgcagaactcacagatggtgccatagatgaggttgatccgattgaagaagtccaccacatgtactgccacccagtcattctggtcctccccactgggcaactgcacagccgccttcaggtccacacccgagttgagggatgcctgagcccgtttgtgcagctcaaacctctgtgtgccaggttcaaatttcctcttgggtcggaaggtcttgtccttgttgaatacctgcttcagggctatggacatggtcttctctttcgcttcctttcttttgcaggaagcgaaaaggcacctggaacttttcagggagagatcacagcccaacagtgttttccactgccagcactcaggccccagtcttacagcctgtagcttttaagctcttctaaacagccccttccatcttcctcttgaatgatttccaagggaacctcatgttctttcctaaaggtagaagagaaaagggaacacatgagtgcccagttcgcctttaaaaaatgacagtcttcaacctgatttccaccttgtgttcttggctgtgcccactctccatccaggtatatgggcatgggggttaagccactgccctgtgactctgtactgttgatgcaaaccatgcaaataactaaagaagaaaaggcatcacacttgttttgttcatggcctttgtcaaatctctactggctcttctttgtgtgatcataggcttagtggacctttccaaggtgttaaggatgaacatgttgatcaatggcctgatcctatcccacgtgtgctagcttttagagccccaccccccaacaactcctattaagtaggcatggggacacttcccccatccttctagatacagatgatggaaaaggggtggctatcacaccaagctggctaataagaatgtctctcctgggaatttggaatcaggactcagccttggttgggcattagtgatgtggcattgggtgagaagtgatgaaaactgggtctggttgaatcttgcttggaccgtgtgtagtgcagttgagaaagctggtctgcagagccacggaggaagaggaggaaaaggagaaggtggagaaggtggctgccaatacacagagaaacagagacaagagcctaagtggccacagagagaggaagacaagagaaaaagagagacagtgagaagaactaatcctgataatcttctagaaactggttccaattccttttgaagcctagctatgcttcatgccttttgggatccattcacatttcctgaattagtcaaagccttactgtatttcagctaacttgagttggttctgtttcttgccaaacattcctaactatgacagtatttgtcaccttccaatgtgccgtcctttatacccttcatctcacactttagacagcactttgaggcagaactgtccaatagaactttctgtttccgtgataatgcaaatgtgttatatctatggtgttgaatatggtacacactagccacatgtggctattgagcatttgaaatgtggctaatgtgactgaggaacagaattctacattttatttaattttaatgaatttaaacttaaataggtgctcacagctaccacactggatggcacagctctgaagtcttcgatgccctcttctccactaacttgttgatcctcacgaaaatctgctgaggtttatagatttataataggtctaatagatttatagtgggtatcattcttcctgggtctccaagagatacaattacttgcctaacaagatcccatagctagctggagcatgctgttagattgaaatccagtttgttgactcctagcaaatgctttctctacatggccatatattcccaaaagtaatggacttcgacttgtctttcctactggtttacaaagcttgttttccccaaagcttctatccacatattccccaaagactgctgtatagattggtcggaggtgaaggctatgttccgtggccttgaaatagagaggagataactgatccactcataggtcaagccccaacaaaatgagccaacagctgtggccagattcagaagagcccaacacggaatctgttaaaatgggcttggagcatgatcccactaactgttttttccctgcctgtaaggggttctgccattccacactcaaacagggcttgatggtactttcaaccttaagttattgaggccaatatacctaagacatcctgattcccccttatcaactctgctcttcgctcagaattgctaaccaggcggtggaatccccgccccacccccagtcccaaggcctctggctctctgcctgctcacttcctccctcttaaccccaccctcttcctaacaggttttcactgaaatgccatatccgcaaggtgggttttttttttcctattcacaggacattgacctttgacccactccccaccaaagagatccatgtggaaaagcaggtcacatgaaactttctgcctgagacagtctgtgaaatcacacttctgggtaccctggaatagcacctgtaaggatatcaacacagaaactctgcaaagtctagggaaagaatggagtgatctcttttcctaaagaataccttcctaaaagagacttagcttgcctgaaaacaggcttaagaaacctgagggttttagaaggaaatttccaaaataaaagaatgagctgaaggttggaaatacagagaaagggtggtgaggacttgttttttaaaaaaacagacaatagtccttctatgtctcaaatgcttaattgctgacagtaaaacagtaaccaccaaacagctgccccctcatgtcttgaacaaatgagacttgctcttctattaatctgataatgagggtaccatcaatgcccacagtcctcagagcaactttctttcatggccatacatacccttggtgccactaatccttctgttttccctcagccaggagtgtctgcttgcatggacaccattgtggaaaccttcctccgcacctgtgccaggctcttgtggatgccatcaacaaacccctctgacacctctgacgggagcatgtgaataacaccgaataatcacaacaaatcctcctcatcataaagccttgcgtggactggcactcgcaaatatttaaataaatattaaaacactgttggaaatttgggaatttttcttctagagatactcatataacaaatttgaagatatgttttttttttttttttgagacaggaagatcacctgaacctgggaggtcgaggctgcagtgagccatgatcatgccactgctggagtggtgtggtgtgatcatggctcactgcagcctcgacctcccaggttcaaacgatcctcctgtctcagccttctaagtaccagggaccgtaggtgcatgccacaatgcctggctaagtattttatcttgtattttgtagagacatggtctcactttgttgcctaggctggtcttgaactcctgacctcaagcaatcctcccgctctggcctgataccagtctcttgaactggaaggacaggtggtattatctccattttacagacaaggaaacagagactcagatctcctagtgcttgattcaaatttgtaaatgattctgacatggtcagacatgaggctgtctctttaggtcaaacttttgaatctaaaatgaagctttcttaagaagaaataggttgatcaggtaggcccccccccatgtttaaagacaatggcaatccaggatggataataacagatgtatcatgccactgaacgacagaacaaagaggcacccatctgtgtcttttcctgagtgtgagatgccatattggcgcaggtacctgagagttttgaaattaaaaagggaactgtaaatgcacctggacttactttcccagcccagagcccccttgggacccctgcccataatttatgctgtgggctaatcaaatagttagaacagtgcttagccaatgtgaactcagggatcttgttaaaatgcaggttctgattaggctggtctaacagtctcccaggtggtactgaatctactggtccatggatgacactcaaagcatcaaggcctgatctaactaagtgatcttgttagaaatgtagactctcaggcttcaccccaaacctggtagatctaagtgtgcattttaacaaaatctcaaaagtatatgatctgagaagtgctgggttggagggctgcctgcctggctgagtaaaggaatgaataaacaaacttccatttattgttttgtcaacagattgtttcataaacagtcttcagttgagtgtgggtatgttcgagaaaaaaaaatgagagatactgttttgaatacaatcgccttgacagatggtgacaatgaccaggtcttttgatctggactgacttgtatagcccagcacccagcacctaggaggtctccagtgaataccttttcataaatgccaggtagagggcagctgctgctattgcggcctcaagcagaaaggtttctttggctgaataaactgtagcactagcaacaacacagtggttattttctgtcctgtttcagtctccaaaaaaaaaaaaaaaaaaaaaagtcataaagttttccttctaagtagaaatggaaagtaaattctatgtcatgaactgcacccatgacaattctggttgttaataaatatttgaaaccaatggttcatttgatcaataaacatttactaaaagctttttatgtgtcagacacagggctaggcactaaggacatagagttcataaaaatgtggtccctgtctatgaagaattcacaatttggtatgtagttttgaggttagttattgacttttgcttttaatactataaagttcaatgcaccaacatgcatactgatgtgactccttcagagtattacttaggtcagggatgaaacaggacaataaagggtgaggtctttggaaagagaaaaacagaaatctaaataaatagcacaaaactgacagaagttccatgtgctctccatattttctgcctaatagatcaattataacaataaaacatgtgcactataaaaacatgcagagagaattcggctgggctgcaagggaatgttgacaaggtagctaagcaacgcactggcaaggaaagttctaatttttcttttcctattgatgtcttttgcctcattagttgagaaatcaaagagtccttgccagggataaggaagaaataaaacaactctcccagtcactcctgagagatccatcttctctagccaggcccacctctaagagaccttggtggtactgaagggtgagggggttaggaaaggagagggactgaagctgataccagttgcaggaaaggcagttcaatatcttatctgtgaggtggaggactcctcctggcaggatcagctgccaggatgattcatttcctataggaaggccataagagaaatgccccagaaacaccccgcatgaaggaggtttagtgtcatcttcattgccaggcacagagctgacttaactgaatgtttgctgaatgaatgagtaaatgacagtgaattacgaacattttacatcacagtgaaaccacaaaagaggaaccaaagtggatctcctgtcttcagttatttggggactctatgtcaatctgtaagctcactgccaactcactgaggccgctgggataccctgaagtaacaagtctgcctcctgaaaggacaagacttcagctcaacttttctttcaaatgagctgctccattcctctgtgttatctgaaattccacctcttcagaatcaaagaatgaccagtctgatttctcattttcccactatattgttctctttatagctggaatagtccttggaatcgtcctcccacttcccaaatattgaattaaagtagattgggtttttattttagaggggtgtatgtatgtgtgtatcataaaatgaacatcgtctgacctttccaggatccaataaaggatgtgcctaagatgcaattccatcagcccttatgcactgtttaccttatgcctacttagtaggtgccatctttgcccacaggacaaccccagaatggaagagattcctgcctgagaagcagctttgctatttttttccccaacgaattcaactcctcaactttgagctgtcatatcactgcattttgttacattagttgggagaaaccttgctgcctcattttaatcttcaaagatatgcatggtttcagagcttagaatgctcacattatttctgaacacagatgaagttagtacaaataggtgtaaccgtacagaagtctgtcacaggactattctgctcatcttctagctcttcaatggtcgtttgaattgcattcttgctgtttcacaggcttattgttttggtcatcagtgcagacattctagcatcaaatgtgtaagtaaatagtgccaaaatgaaagcattacctgtaaccttatacactgtagcagcagcaacagctacaatagatgaatgcacaggtgttttcagcaaaaacctataatgattcatcatcattcagaagaggacacttagtggtgagaaagaatggaaagagtaaaagaaaagagtgggatttgtttggtatggtttgaaacattacctactgacagtccatggaacaaaagacagagttttaaaaaatgttttctgaaataaagagaataatgttccttctggacaccagtaccaactagcttagattcccaacaatgacaaagatgaagaccttttggtcaaaccttgggcagggttgatccaatcttactgcagttgtaaaaataaatagtaaagtaaaattattacaggataaaagctcagatgacctatttaatcttataaagattataaatcttataatgacatcctactgattatactgattttttttaaaagaaagagaaacttctctaagtcagtgagagatttggtatattatttccagatatttagactagctggaaaatattcatttttgtggcttaaagaaagacacgtgaattgaaaaaaacaatatctaagtcaggtgagggtagaagaatgggggatgggatgagaactacagataaagcttaagttatagctgaaataaaaaattaaggcaggtaaaaaatgtaagtatttttactttttaaagcatgagtgtatatcagctgatatgatgtcactctgaaccttgaacggatattgagataagtatttttactttataaagcatgggtgtatatcagctgatatgatatcactctgaaccttcagtggatactgggataaaggtcattgtcagttaccctttctttttctttgaaacagcgtatgtcaatcctttcttggaaaagtcttaaaggaaaaaggttcaaattcaaggaagttggatcctgtaactgacaacagacttgtttactcttagccactaagtgaacttgagtctcaaagtctgaaaaatttctagccctagcaccatgagaacttatgtatgacatctggaaccattgcaaaagatctttgcaggaaggtggagaacacaaaatgggcaagaagactggaaattcgaaaatacagtttgaattttcaaaagatcataagtttaagtttgacaggggataggtaaaattaacaccaagagcaggcaagattaagaggcactaaagcccagtggctaacagcacacagcttttgcagggttgctgcaagaattcaaacagtttacgtaaaacacttagcattagcaagtactgaatatagtatagtggttgttgctatcatcatgttcatcatttgaatcatattatgatacaagttttactagagagtcagattcttgagagaccagtcacctagaatctatcttaggatgcctaaaattctaattatataatattaacaatggtatttattaaggacttcctatttattttagttttcacaaccttatgaataggtattattattattatacctaatttacgcttaaggaaactgagacacagtgagattgaagctatatcctgatcacagaaccagtaagtagccaagctgactccaaacctcttaccacctacttaaaagtgcctctttagacagttgggtagttaaagaaaaaaaacaaaacagaggaagttctggggtacacctaagggggtcagggaggaaatgggagaaacagagacctagccctatgtacattgtcatgtgccactccagaagagatctatttctggaaacttcgcggtctagattcaaaagacctggattcaaattctggcaatgactttagctggctatgtctttgaacagacactttttatgaatctcagttttgtcttctttaaagatgatggtggctgggcacagtgactcacgtctgtaatcctaacactttgggaagctgagccaggctgattgcttgagcccaggagttcgagaccagcctaggcaacatggcaaaacctcatctctacaaaaaatacaaaaattagcccagtgggacacgcctgtagtcccagctacttgggaggctgaggtgggaggatcacctgagcctggggatgtccagactgcagtgagccatgattgcaccaccgtgctccagcctgggcagcagcatgagaccctgtctcaaaaaaaagaaaaaagaaaaaaataataaggataacggttaatggtgcttacctttattgtaaggttactgtgaaaattagaagagatattgccagtgaaagtgcttcacaaatggaaaacaattatatggttattgacatagtgactgataaaagaaactatgacttttgacttaatatcaagaaatgatgtgagaaacagaaaatgattcagttcaatgcaaatgtgtgtttacgaataagaaataggcaggaggtggtaggggtggggggcacggtggcaatggaagccctgcataggaggaaagaaagaaagaaaatgcttcattcttgcttaatttgggtggacttctaattctcaggcaaaaagaaataatattaacctcagtgatttgataatgagttaacaatattccccaacatttataacacacttaccctaatattttgagggagttccagtatttttttgcatataataaatctaatgcaatatggcttatttcatgaatttgggcaaattatatccaccatgccctcccactaatccctcaaacacttttcagaatagcatataaatactctacatttaacacattacattcctggttataatccagttacaacctctgtattctgataacagaaatgactttctaaactgtttaaaaagttattttttatattagctcattttcatgctgctgataaagacatacctgaaaatgggaacaaaaagaggtttaattggacttacagttccacatggctggggaggcctcagaatcatggcgggaggtggaagacacttcttacatggcagcagcaagagaaaaatgaggaagaagcaaaaaaagagacccctgataaacccatcagatctcgtgagacttattcactatcacgagaatagcatgggaaagactggcccccatgattcaattatctccccctgggtccctgccatagcatgtgagaactctgggagatataattcaagttgagatttgggtggggacacagccaaaccatatcattctgcccctggcccctccaaatctcacgacctcacatttcaaaaccaatcatgccttcccaacagtcacccaaagtcttaactcatttcagcattaacccaaaagtccatagtccaaagtctcatctgagacaaggcaagtcccttccacctataagcctgcaaagtcaacagcaagctagttaattcctagacacaatgtgcgtacaggtattgggtaaatacagctgttccaaatgggagaaattggccaaaacaaaggggttacagggcccatgcaagtccgaaatccagcagggcagtcaaattttaaagctccaaaatgatctcctttgactccaggtctgacatccaggtcatgctgctgcaagaagtgggttcccattattttgggaagctccacccctgtggctttgcagggtacagcctccctgctggctgctttcatgggctggcattaagtgtgtgtggcttttccaggtgcacagtgcaagctgtcagtggatctaccattctggggtctggaagacgatggccctcttcttacagctccaccaagcagtgccccagtagggactctgtgtgggggctccaaccccacatttcccttctgcactgccctagcggaggttctccatgagggtcccgcccctgcagcaaacttttgcctgggtatccaggcatgtccacacatcttctgaaatctagggggaggtttccaaacctcaattcttgacttctgtgcacccacaggctcaacaccacgtggaaactgccaaggcctggggcttccaccctctgaagccacaccctgagctctacgttggccctttcggccacagctggaatggctgggacacagggcaccaagttcctaggctgcatacagcacggggatcctgggaccggcccacaaaaccactttttcctgctgggcctctgggcctgtgatgggtggggcagccatgaagatctctgacatggcctggagacattttccccatggtcttagggattaacattaggctccttgctccttatgcagccgacttgaatttctcctcaaaaaatgggtttttcttttctactgcatcgtcaggctgcaaattttctgaacttttacgctctgtttctcttttaaaacagaatgcatttaacagcacccaagttaccttctgaaagctttgctgcttagaaatttcttccgccagttaccctaaatcatctctctcaagttcaaagttccacaaatctctagggccaccagtctctttgctaaaatataacaagagtcacctttgctccagttcccaacaagttcctcatctccatctgagaccacttcagcctggaccttattgttcacatcactatcagcatttttgtcaaagccattcaacaagtctttaggaggttccaaactttcccacattttcctgtcttctgaacccttcacattgttccaacctctgcctgttacccagttccaaagtcacttccacattttcgggtatcttttcagcaacgcctcactctactggtaccaatttactatatttgtccattttcatgctgctgataaaaacatacccaaaactgggaagaaaaaaggggtttaattggacttagagttccacatggttggggaggcctcagaatcatagtgggaggcagaaggcacttcttatacggcagcagcaagagaaaatgaggaagaagcaaaagcagaaacccctgataaacccatcagatctcgtgagacttattcactatcacaagaatagcacgggaaagaccggcccttatgattcaattatctccccttgggtccgtcctacaatatgtgggaattttgggagataaaattcaagttgagatttgggtggggacacagccaaaccatatcattcctgttatcattcctgttatcagaatccagagatcctgccagaaggattaagtctgcatttctagaaactctcaagagagaacagacaaccatctagctagatgatttctcatttttctacatgaaaaacaggtacacaaagcaggtaaccctgagataaaattgagacaaataattaatgattctacccactctattctctcaaacatgccaataacaagttaaaaaaaaagtttgaaatgaaattgagtcagacatgtaattgcaaaccatgtatcctcctcaaagactgaaaagaggtctacctttagagccagaaagatgcaggtctgagtccagactctgccccttgaccagttacccttgtgggctaaatgctttctctttgtgctttaatttctttctttgttgttagggtgctaataccaatatcacagtgggttttggggataagtgagataatataagtaaagataggtaaatgtcaagtgttaaatttattaatctggatttctcctatgatcagatttcaggtggtgtgatgatcaataggagtcccaaccataatgtgctctttctttgacttcttccccacaagacctaagcacatgaccctcaaaaagtgtaaaatcttgaggcacctcagagggaagcaccatttccccactcgtggtttggatgaggaagaattttccctatgcatcctactatcctctctatgtccttttactaacatcgccccagggcaagtggagggatggattcacttagttggcaaaccgcacatgctcagctggctcagcctgaccttttttcctcctgcgaagtgcctgctttcaagtgtgctacctgctgcttccccagctttctgcctttatgaatggaattggtctgctctcaccagtgctacatgggaaagggtgggcaaatccagagtttagagttaacaggcccattggttaacagtctggcttccataagaaacaaagttgatttttgtttttgttgttgtattgttactatcaacttctttgaagccacatagggaagagtggtgtgacttgtttattagggctctattggagaactaacattgttaagttgtgcagagtggcttggctatgcaaagttagctgtttttgttagcagagactcttcgtgacattagttcaacaagaactctgtttaagacataacttactcatctgcagaaagtctgtctacacaccagaaatgcatagccttctcaagagatttctcagctaagaaagaaaacctagtcatagggtgcatttgtaccagttactgctcagtggcagacacacagagacagactgctcagaacagagtcccccatcatctatgaagtgcttctgaatcctccacaattgacagtgagctttaggcctgacagtcccatgcccctgtatgtggctactgtctgggaacatgattatcagaagctttctccagggaactgaaaaactttctatccactcagataaggcctctcccttgcccagcctcgatttcctcaaacttctctctggcttaacttcaactcctggtaaagcagagggaacaaggtaccaaaagaaggagcaagaaggacgggatggctggtcatcgtgtgcaccttgcatgcacatctctgatgcgaatgccccaggaccacatactgtgctgtatttctttgctcacatgtctggcccctccatcagtttatgagggttgggagcacaccctagacttcactgcatccctggtacctaacacaggacccagcagaaacaggaactcagtaactttttgtggttaaactgtgtatctaaatgattgttaatcaaataccgcacagataaacagttctttctccagttgagaggactaggcccccataatcataatgagacaatggacaaaaggaatcttttcagaaaacagaactacttcatgcaaagatcaacagtggctactggacatgatgtttcccaggccaatctaaacagctcccatgttttcattttctagcattcagtgaaaagtcagctcctttggaagcatgcccactggcttaaaacaatgtttaaaaagtcatggtagaactttgtaaagatctttgcaataccacgcaaagacctttacctttgtgctttgtttaaaaaataagttttaaaaatatacctcagaggaaaaaataatggggaagagagcaagctaatcaacttgggaatttttctttttttgtagagatgggggtcttgccatgttgcccaggctggtcttgaaatcctgggctcaagcagtcctcctgcctcagcctccctagatgctgggattacagggatgagtcacagtgcctggctgggaattttttttctaatacgagaaaaaaaatgtatcatctcacctcctttagtgaaaactcaacttctgtgactttggtgtccatgcccaagcttctgtctctgttgcatccactcttgttgcctttgtacccttcagtgacagcatcctggcccctaacctgtctccctcaatcatcccacacaacaccacgacattaattttcctcgaactttgatcctgctacccattccgtgtgcatctgctagggaggcctgatagcaaggtcatggctgacaggattgtacagcaggaagaacttctgaacatcagttaattcaatagagcctcttaatttattaaaaacaaaaacaaacagctagtgcccagaaaactgaagtgaatatttaaaggttcacagttaggacagacctggggctgaaaacaaagcctcaacctcagtgcctgtgttctttccactaggcaatggatctgtttaatacttcagcaagtctgacacttaatggcccttcaaaacttcccccctcccttttcgtgccaggcgtggtagctgacacctagaatttcagcactttgggaagccaaggcaggaggatcgcttgaagccaggaattagagaccagcctgggcaacaaagcaacaccttccccctcccccagccatctctgcaaaacaaaacaaaacaaaattagcctggcacggtggcacacacctatggtcccagctatctgggaggctgaggcaggaggaggatcacatgagcctaggagttcgaggccacaatgaactataatcatgtcactgcattccagcatgggcacagagtgagaccctgtctcttaaaagaaaaaaaaaaaaaagaaaagaaaactaccccaacttaactgtctttttagatctatggagagatgtagatatagatattattcatattcctggtgatttttaagccttttaaagcaacatagctcctttgttcctccaaatgaagttttatgcaggccctcaattttataaaaataaataaaaattatttatctcttctgcagctgaagcagggtgtctactcctctcaacagccactgaaacacctctgagaactttcaggtttcgcttgatcaatcggacaactccccagacccctaatgctgactgcacttgtcagtggctaaatccctgcccctgccctttcttttgccttccgcctgccataatcctccagcctccaggcgacttctccctacagtgctgttaggaagtgactcttgtctctcctttgctccaaagctctgaatctgtagcccttcctttgtatctaaacagtccgatttgttggttattctcacagctcacccccaacttctggcccatctataatcagggcccacccacccatctgttagccctgtgggcccatcaaagcaggcttcaaacacaagctgccacctctggtggaggttcagcctaccccttccccttctctcctgacccttccctaatctggctttgtttctgccatccctgccgcactcatttggaacccttgcttttctcagcaaatatttatgggtttgacttgttcttattgagttctatactcttcccccagcactgcctccccctggccttttatcttttgtttgtttgtttttttctctttcacttttccccttttgagctctggcggctctggtagaaggtggtggctgctgaaggaaaaaatacaaccccttctcaccctgaaccatctgtccacggactaactagtaagttccctctgggtttcctggggacactcggaaatggcagaaagaccaagatcacttgcacctggggtgcaagtttaaaatgcagactctagcatcccacccctcaccagtggatgtgtggactctgctgctctccaggatttaagagctccctgagccagggagtctgacatgcctggcctggcatatccagtggtccatgggccaaaagtcatttcctgaggcgaataggcaggagacaaaagtggtcatctgaagagttgtatttccagcagtaagaatggcagaaaaagtccttgggggaaaggagaattaacctgaatcattattgggaatatacaacatggccctgcccctactggtctacaccacctgtggagaggctagttcaatgaaccacccctgcgctttgtggctcttggtcactgtgttgtatagactggtcgttaagtaaatggatctgagatcagactgcccgattttgactcccaaatctaccatttctagagtgtgggctctggagcttactatatcacattgctcaacgttagcttcctcttcttccatttctgtaaaatggagataaaatatccatctcaaagggctgccatgagagttaaattacattatccaaataaagcatttgatatagcagcaagcgcaaggtaagtttgtaatatgcattagctttaattcttatcactaacatcatgctttcttgaacttactcatatacatatgtctccctccttctggatagggaactcctgaaaagcagatcccacaggctgctacgttccctctctcctaaaacactcttagtgggttataccttgcaggattgtggtgatcaactaagacagtaggtgaagagaggttagcagcgggtctggcacactgtaggccagaaagaatcatcccgagtccaagggtgctttttaaataccaaatatcttaatcctgatgtttttatgtaaccacaatgtgtagacttgtcaaaaatgttaaaaatagaagaaaccaaaaatcaaagagaaaaatcttctcatagtttctaatccaacttgcatggaaatagttatcttgcaaaagagtgaagggtgtaaattttttcattcatttaggggagttgttttggtttttcttgttttattctttgggtagtttatttgtttttcccacactattttttttttaatgacaagtaagggtgacaccacttttcttaaaaacaataaaagctacagaaaaaaaaaaggctttaaaagtctccaaaggcctcaggaacttttgcccagagaagtgtactcctcaagcaaagccatggaaaacaacatctgccacaggcgcagggctgagccaaacccctgcggcgagggctcgctttatttttggtccaagctgacagtacaggaagccacatccactgacttctttttcatttaagattctacattcatcaatacgtcttgttaggtaagcctccagtggatttcctctatttggtctaagaaatctgaagaggaaaaacagaaacacacagtcaccattcctaggaaaatagtatcagcccagcaagagaccaaaacaggtatctggtaaaagctcccactctattctctttaaactgcactttattctaaaaaaaaaaaaaaaaaaaaaaaaaaagagctccctgagtttaaacagtgtttgattttatataagcaccagatgattctaattccttttggaaaaaggtggtggaggattccataaaaactctgataatcatttcttctaccaactttagtcaacaaaaaaattgaaaggcttaacgtaggtgaaaactgaaaaatacagagttccgcaaacacaagttaagactgtcatttttaaaaagaagcatctaaaagtcactttggtgcatctcaaatgcacgtctttacataactgatcaagatacaaaccatttgcaaacatttatgttttaaatcacagatagctattccaactcagagattttaagtgattacacaatgaactggtcctcatttgctctcccttaattttccctaaccttgcatggcttctagaaaaagacaaaaactgacagacaagggtagtatggccaaggagccctgatttatttcagctttgaaaggccactacacttggattctcatttctgcaaggaatgcaatccagagagctgagctcgctgtcctgaataaagtacacgtttttctcatctagcggagtaatcttgtgaaatgtgagtacaatctgcccagtgtctgagggaggcaaagggggagggtggggtcgtgctgggacacagaggagtcactccctgtttggagagccacgctcctagagcaccaggctcacaggagggcacaggcaggaggcaggatcctggccttcacggtgcccaggaaagagaagctgtccaagctggacaagcagagagggacctgttgccctgagagctagtcgctaaactaatccacatcaaggagggccatgggcctctggggcaacacagggacctgacaatagaaagcaaggggcagtgtgggaaggaatctagcaccttctccaaccaagaggtcagccccaaacaggggatgttggtgatggaccccatcaagacattccctcagcttcatcagaggtcatgcactctccccagttccacacacaccccaccttgctcacaagcagaaggggaaagaaggcaccttggcattcatttgggaagctgccaagacagtctaatctttcaaatggggcatctaacctgatagcagccacagtgcaatagactacatgtgttcaaattctaacctccaatgtgatggcattaaaaggtgggacctttggaagatagtttggttatgagggctctaccctaatgaatgagattagccattataaaagggaccccagaaagctttctaccctcaagagggcccacaccagaacccaatcatgctggtaccctgatattggatttccagcttccagaactatgagaaatagattttctgttgtttataagccacccagtctaaggtatcttgttacaggtagcctgtaagacacacagatatttacacgatctcatttttattatagtctaggtttacaatgcatttaattttataaagccttgtatgggaaggagataaagtaatagtgataataatttatatttcctccaaccatatctagtaaacacaaatgggtccttttaagtaaagtttctttctgactaataaggaaataaatgtatacctcattactgtatgacctcccagaagctcatgagttctgaggatttagaagaaattattcaagtggaacttccctagacatcatgggcccaaactgactccttataccagagattactttttaattcctctcatcaaggctggctgaataaaccttacccatgtcagcacacaagtgaaggcaatgacattttttaatggcataatccaggtcatcataccctagaatagtcaccatgatgcatgtgcctgctgattagaaccttcgtatcattcctgttgcaagacacatagctacttcctgttctggaagttttggaggggtgagaaaaagaagggcaagaagggaagagacattcatgacaaaatctggaaaggctctttgaggagctatagcctctccttctcaggcagtagcaaatagtctcatcaaaacaaactttgaaatctagaatgaagattttgaaaagaaatccactgttatatatgaaatgttaaaacatgcgtactttttccctcagcaaacccacctttaacaatctatcaaaacacaaatgtattgggttatggtgccaggcagatttctaaggtggctcctagtgatctctgtctcctggcatccatgcttttgtataatgctctgattgagtgaaggctggacccagagactgacttctagtgaacagaatacagcaaaagggatggggcactcttctgagattagcttataaaacactgtgacctctcttgctcacacactcttgctctcgctttgatgatgccagctgccatgttgtgagctctcctcctgagaggcccacatagcaaggaactgaaggtgccttccagctaaaagccagccagtgaggagcaaaggccctcaggccaacagttcaccaggatctgaatcctgccaatgaccactgagtaagctccgaggcggctccttcccagtcaaaccttgatacagctgcagcctcagccttgggagagatcctgaaccggagaacccagctacgctgtactctgcctgctgacccaaaaaaactgcgagataataaacgttgttgtttttaaaccactgcattggaggggattctgttatgaagcaatagataaatcatacagctgtttaagcctcattgtttataatcacatacaaaaggaaacaaccaaaagtccattcattgataactagtataatcaagaatggcatatccacataagaaatattgggcagccctcaaaacacagggaggtcaatatatctgtattgatatgaaaagaagttcatgaaaatcaaaaagcaaattgcaaaacaacatgtgacttttaaaaaatggcagatatcgacatccattcctgtaaactccagataagctcctcacccagtgttctcatttcagaaaacaattctagtagtctagttgctctgtctaatcaatttgaaagtatatcatttacttcaaattgccaacacatcccaaactcctcacaccctccaccacaactactcttgtccacaccaccagattctctctctttacagctgccattgactgggctggttgcactgcctccacttctgctcctcggcaaactattatttccagacaggagccagagtggtactttaaagatataagtgaaatcaggccactgccctcttcaagccctacaatggcttcccatcacactcagaataaaaacaaatgttgctatattggtttacaaagtcatgatctacagatctggcccctggatacctctccttcccctacgattctctcccttacttatctgctctatccacagtggcctccctgatgtttctacaacatgccaagtcttctatcacttcaaggctgtattagtttgctaggcctgccataacaaagtactcaaaactaggtggcttaaagaatagaaatgtactgtctcagttttggagacaagaaatctgaaatcaaggtgttggctgggcaatgctttctctgaaggcactagggagaaatctgtttcatgtttccgtctttgtttctggtggggttttttggtatcttcagtgttccttggcttgtagactcagcacctcaatctctaccttcatcttcacaagttatccttcctgtgtgtatgtctatctccaaattttccctttttatgaggatagcagtcattttagattagaggcccacccgactccagtatgacctcatgttaactgattattttctgcaataaccctgttttcaaataaggtcatgttaaaaggtattgcaggttaggaattctacatatgaatttgggatggggaacataattcaaccccaaaacaactgcctttgcaatcactgtcccctcttcctgaaaagctctttacccagtgtggctgccatgagactatgccttgtagacatccaacttacaaggagtattactggctaggagttacagctgctgtgctctgaaatccatctctgcatttgtgctgaagccacatttctcacaggctactcctagatagtgactgagcatggcaggcatagtgatgcaaacctattcctgggagatgaaaacttacctaagaggtggcttggactcaaagactcctccaagagatccaggctctcttgaaacagcacagccctgtaggatgcttccgctcaccctcctccctcccgtcttcttcacctggggtcagacctgcatcacaatcagaggagtctcccgagctcccagcagctcactcctactttccctcatagtcagacagggcattcaaaagggctctgtgcttggttgaatactcctctgcagccatcttggaattcttaatgttattttgaacaaggagccccacattttcattgtttccttgacctcactcttgctcacaggagttgccttaataaatctcttgcatagccaatcctgccttggcgtaatgcttcttggagaaaacggactcacaccccagataccagcatgattcttcattactgcatgtaagcctgtgctcaaaggtcactcctcagagaggtttcctttgccaccctaataaagcacatgacccaaaccagtccctctctctcccattctcctgctttaattttcttcatcgctccagctgattttactatatgttttacttattgtttgttttgtctttcccatgagaatgtaaactatacaggagcaaagacacagtgttatttattgttgtgccccagcacctatgacaaagtcaggaacatgataggtggccaataaatggtttgtgagtgaattaatttacattaaaaatgtcagtctgaatttacccagatcctctttcagttccaaaatataagccatggcagccatcacaagaatgtacctcatatacctgtaagacataactgttcttcttaatgcaggccagaaatgaagccagaatccaaagctaaaccaataagaatgagagcaaatactgctatcacccagaggggtgttgaatctggatacagctgcttaggggtttagggctgggatgcccatttgagaacaggtgacatggcccaaggctcatgcaaggtaagatgctggaactgacataactgcatcaagtcagaattcttcaaaatatccatttacataaaaacaggactagaagaactaccactgctccaagtagctcagggaagggggaagtaagtctgaattgtgctccagtatcagggtgaaaaaaaatgcatccgattaaaaaaactaaatagaacaccaagcctatgtcatgcacaagtgtgttgcacaaatttacattgtttaggctgtgtaagtatcttgaactaatagatcactataaaaatgttcccagaaccagggaagaagcaaactcaaattgttctgtagaaatattttcataactcaggacctacaagactccctcagaataaacaattcctgctgaataaacccacaaagaatgaagccagtcagaaggagaagccacgtacacaatgagcagaagaattagcacctctaagaacttacagtaagagaataatctgacaggatctataagctaattacgtttaaaagttttttttaacataaaagaaggaataaaaaccataataaaagaaccatcctttatgaacaaagggcaactttgaaaaaaagaactaatttgaattcttaaagatgagaaaaacatgttaaattgcatattagatacagctgaaaagagaattaccatcatgaaagatgggtctaaagaagtgttctgaatggagcagagaaagaaaaaagggatcaaaaaatgtgaaagagaggttataaacacagagagtaaattggggaaataaaacacatttaattgaagttctggagaaggagtaggttatgtgagagtggcaatactgaaatgataaaagctgagaatttaatagcattaaagcaatacatatgttcttgatttagaaaattacaagtcccaagcaggattaaaaagacacacacacacacacacacacacacacacacacacacacacagcggtaaatggcagaacactagcaccaaagagaaagtcatacaagcaaccagagagaaaaagataaattacaaacttaataatggcaattagattggtggtggacttttcatcaataatacagaggccagatgataatgaaatgacattcaaagtggtaataaaaaaacctgtcaaactaatattctatacctaattaagttgctgctcaaaaatgggggtattttaacctgttttacgctgctataacagaataacacagactaatttacacagaacagaaatttatttcctcacaggtctggaggctgggaagtccaagagcaaggcaccagcaactactgtcacatcatggcagaaggcatcatatgggcaagagagagagagggaaggaggctaaactcatcctttataagaaaccccttcctttaataacaaacccactcctactacaatgaacttactcccatgataatggcattaatccattcatgagggcagaaccttcaggacctaatcacctcttaaacttcccacctctcaacactgatgcattgaggattaagtttctagcacatgaattttaggagacatattcaaacagagggtgaaataaaaacatattcataccaaaaaagagagactatccaattcatagacccttgctgaaagaaatattaaagaataataacttcgatatgaaggaaactaagaaaaagataaataagcaatgataagcaaagaagacaaacatgttagtatatttataaacacccctactcaaaaaaaatttttaagattaatagggaaaggcattataaacaacttgaaactaaaacatcagatagcaataatatgaaagagtgattaacttaaagtactctatggcccttgcattacgtgataggggaatagaaattttgaataacttaaaactttttaaaagctaagctcgtgctttgggaggccaaggcaggaggtttgcttcaggccaggagtttaaggccagcctgggcaacatagtgagacctagtctctacaaaaagttttaaaaattagctggatgtggtggtacgtatctatagtcctagctacttgagaagctgaggcaggagaattgctttagcccaggaattcaaggtaacagtgagctatgactgcactactgcacttcagcctgggcaacagagcaagatactgtctctttaaaaaaaaaaaaaaaaggctaagcattcatattattcatataatattttcaggggaaatgaggaaggaaatgggagagaagaaatagaatgcataacttttttttttctttgagacagagtctcactctgttgcccaggctggagtgtggcgcaatctcggctcactgcaactgcaacctctgcctcctgcctcagtctctcaagtaactgggactacaggcacatgccaccatgcccagctatttttttttttttttgagacggagtctcgctctgtcacccaggctggagtgcagtgacgcgatctcggctcactgcaagctccgcctcctgggttcacgccattctcctgcctcagcctccggagtagctgggactacaggcacccgccaccatgctcggctaattttttgcattttttagtagagacggggtttcacaatgttagccaggatggtcttgatctcctgaccttgtgatccgactgcctcagcctcccaaagtgctaggattacagatgtgagccaccgtgcctggccccagctaatttttgtatttttagtagagacagggtttcaccatgttggccaggatggtcttgatctcttgatctgcctgcctgggccttccaaagtgctgggattacaggcgtgagccaccgtgcctaggcagaattgtataacttctaaagtagtagaagaaaggaaagggggaaaaagaatactcaaatgagacatatacagacaaaatatgaaaaaaagaaggaattttaaggatgtaagaatataagaaagaattaagagaacagaaaatgataaatatataagtaaatcaatacaagcactgactctataaaagaataaaagaaacgatgccttgtggagtttgaaaaattatatagacttaaaatactcaaaagactagtgtaagaattgcggggagggataaataagaagggtgttattcaaaggaaggtaaaactattgatcactttagaatttagtaagttaaagacgcatgctataattactaggctaatctctgaaagaataaaacagtatgcctttcagagtggtgcagaagaaaaaacagagtgagacaatgaactcgctcatccataaaaagacaaaaaaggcgagaagaaacatagaaactgtgcaacaaacagcacaaaagactccagcagatatggactaaaatatatcggtacagttaattataacaaatgtaaatcaactaaatgctccagctaaaagatgatggcaaactgaaatgcttactggggcagagtaggtcacataactgagtaaacagccaggtgtaggaaagcaacaacccaaataaccacaactgatgtctcctcagggtcagggagacaatagagtgtggtggcgcctggggtaaactggtaagcgtgtacctgtctaaggaaggtagtttttttttttttgttttttttgtttttttttttttttgagacggagtctagctctgtcgcccaggctggagtgcaggagtacagtggcgtgatctcggctcactgcaagctccgcctcccaggtttatgccactctcctgcctcagcctcccaagtagctgggactacaggcgcccgccaccatgcccagctaattttttgtatttttagtagagatggggtttcactgtgttagccaggatggtctcgatctcctgacctcatgatctgcccgcctcggcctcccaaagtgcaaggattacaggcgtgagccaccgcgcccagcctaaggaaggtagttcttacagatcgttgccatgtgggaatacagtccaatgtcacatatgttaactttcaaaaacctgggaactcggagttttatgggaaatcagaattttaaacatcagccatgaatttttttttaaaaagcaaacactgaaaaaaggaaataaaatgctattgatccagtggagggaagaaaagagataagatgaaacaaatgaacgaaaagcacggtaaataaaatgcaaaaacaaaaaaacataaagcaaaagggtggaataaaaaaacaactctttcaaaccactgaaacatgaatggaagcgaaggcttatgctaaaacgccactgtgatccccaccctgtaatttccgccctgttcaaccttatcatttggctgaagagacctaacattaaaggacgggaaaaacattaaataatccaaacataaagcacatggagccccactggccactcaaaactcataataatgtctggatggtctggatgtttgttccaccaggtctgcttacaccaagtctcctttgggggcttactggatacctgggcttatctagctattaagaaaaacggcaatgttaaaaggaatgctctgtgcctaaaagaatggagaggaggaagaagagaaaggaaaagaaaaatccacaacattcaccttaagttactctttgagccagttcctggaatgtcagttcttccccatagaccttactatgaggtaaggtctcaaatgttcagtgtggcttccaaggcttttcagacctggctcagttgcatctcaacctctgcctctacaccattgcccgtgctggtggcctgcccagatgtctttatctccccatctgtacttcccaccaaaccctttccaagtgaagcattctctaaaagttgcttgaggttcctgacaaaatccctgtataaggaatgcaccacatggccgtttttaagtttggttgtactctgcaaaaatttgtgtaatgagacaaagaaaattgtattcatcagaaggcacatggggaaaatgggttggcctgataaggctgcttctggagagaaatgaagccaggataaggactggactcttttcctagagtatcttgccttgaacaggcctcctgctaacctgtcttatccactggaaaacatagctacagcgcttgcagtttaatatctttaagaggtgcacatacatatttgagggcttaaaagagataattgtttccaaaatacaaagagataaacatgacaattaccaaatgtttaagtaaatgtctacaaatatacggtactttttttttttttttttttttttttgagacggagtcttgctctgtcgcccaggctggagtgtagtggcgccatcttggctcactgcaagctccgcctcccgggttcacgccattctcccgcctcagcctcccgagtagctgggactacaggcgcccgctgccacacctggctaattttttgtatttttaatagaaacggggtttcaccgtgttagccagaatgatcttgatctcctgactttgtgatccgcccgcctcggcctcccaaagtgctgggattacaggcgtgagccaccgcgcccggccaatatatggtacttctttcattgttaaatctaacaaatttcaataacattttgtttcaaaatattttaaaaatattttcttgtgcatgaaaacaattagtaagttaagctgactttctttttaagaattcttgactgcatagctcctgagaaaacagagctaatcataaattgaatgacatacttacagtcaaatgatttcaaaggcccaattataaaggtgcttttcatcgcttgctgcacagattatatttaatgtgaggtgtgggtgcacgttgttatgtttggtatgctcgtgggcagaagaggaactaaggcctcagaaaatcttaaaagacctggtcccatgtacagcaggagggtgcaaagagagctggtattaataggatgtgaagcgacgtagggggaaatggcagagggtgtgtcacagctgagtggtccatttgctgctgctcgcccttcatgaatgaaatcttcaaaaaagctacagactctggaaaatgctgctttccactggatttcttgtaggggataagggtttgagtccaggtgacagagccactaaggagtgccagggcagggtgagggcccataacgagcttatgatgccaagcattggggttcaggccaagttcttcctgcatctttgaggggcagggatgccccaagtgagaattgttacctgcatttcataatatatgctcttctcaaaatgcaggtcctatcacagttgtctggagctgagggtgagttgaacatagaagtgatcaggagtctttctaagggctcccattcagaggatcccattaactcagagaaaaacgggaagagataataaacagccatcacagaagacactgatctaacaaggtctcccagcatttccacagcagccccctgtctgccatgtagggggttgagaaggtgggctgtttgctttcagttataatgggtctatgctaaaaacaaaacaaaaaactcaggcgggagtaagaagccatggcaagtggacatttctccctgtgcaaaactgatgagtgggaggcagtaagaagagagcaaactgaagtgcattatttttcatttatttttactttaaataaaaagcataaagaatttgaaaatattttgttagccttcaaccttcgagtcactttaacctatccacattaaagggccaccataaaggcttcatgaatagcagtcccaggataattcccttctgtttgcttgttcctgtgcatttcatgtctgcccacctcctgagccttgcacctgccctgtgggtttggtgcttgcacaaatcaaccccccgacccccggcctcctctaccctgccctgagaactcagcgttccatgcatcctcaggctttttctgcaggctgtcaaacccaggcatgagctcaccagggtaccagctagtaaactacatccacacagtcaggttgaggtatccactttagaaggggactctgggacatggagtacagtgaccattatacctcagttaatggaaacttgactcccagcctttaaccctgacaacacatgaaccaccccggaaaattggccttgccagtatttttaaacagaccacggatccaagttcgagacaagtgttttgcgtggccagatggacagtttcagctggatgtctcaagggcatccagtccatatattgataatatatcaataacaacaaggatcatagcaaatacttctatatatcacttattctacaatattaactcatttaatcctcgaaacaacccatgaggtaagtactgttattattcctatcttaacagataaagaagctgagaaaggttaagtaacttacccaacaacaacctggcaaggtagggactgtggagctcattttacacaggaaggaaatgggttcactgaggttaggtgacttgcttgcagaaccagaactgaaacccacctctgctggctctaaagcctatttcctttctaggactcaaggcctctccaacaccactatttctgttaagagctacatctgtctcccaatcacaaagccccaaatgtcagcattgccttgggcaaatctcactgattctgtctctggaatgtctccaatattagcccctttctttgcactccaatggctcctgctttacatttcactttcatatcgacttttgtgtggaccatctcaaactgattttacatcctacattctcttccctctctaccctcatggaaaattactcttctttaaaacacagctctacaaaatgtcaacagcagaattaccatgatatcaatttttcccccttgttctcttctgtgtttattgagttaaaggcattgagattatattccttttgtaataggaaaaaaatggcagaaacaaaacactatctaatgatgttaagtcctgtatgtataaaactcaccaacactattgctaaccacataagtgcaaactcactgagctgaactattcaagactttttacaaagagagtcaaaaatctataatttgttcaatcaatatttcttgagcacttggtacactaggctgggttttctgtaatgaatgaaagatataactcttctcttagtggagcttacagtctgttgggggagaagccattaaacacacatacatgatgtacaattacaaattgtgctgtgtgccaagaatgaaaagagcaagtgccacaagacaggacaacgggcaagagctagtttcgatggtggaccaggaatgcctctttgatgaagatacttgtgcacagagactagaaggattcagggtggcagtattagaagcaagtcaaagagtatgaagaacttccaacgcaggaggaccggtaagtgagaagacctgtgtgtaaacctgtaagccaatacctatctaaagtttcatttgatgaaatctattaagacttttaagaagaagatctggaacaagaaatccaaacaattaataggatagaaaattgatcacttctgcctctggctcaaatttgaagcacccttcaaagcattatggaggcaatgaatagaataacttcctgtgtcttgagtaatcacatcccaaatgaacagacgcataagtggatcaagcctaactaaagctagtcctgtggcatccaagtgtcagggtttcatattcgattaaaactttcacctggcattcaagggcccgcattctgattacaatctaattttccagctttatgttagttagctctggccttctagagatgagaagcagaaatccacccaggctagtgtgactgtggggagaagtggtgctttaagaatttaatgggaataaagaaaatatgaggttcatatgaatctaaacaggagttaaaacaggacttggccatgtataaagtggaaagactcaaggcagcttaagaatgcttagtgttggggctgggcgtggtggctcacgcttgtaatgccagcactttgggaggctgaggcagatggatcacttgaggccaggggttcaagaccagcctggccaacatggtgaaacctcacctctactaaaaatacaaaaattagctgggtgtggtgtcacatgtctgtaattccagctactcaggaggctgaggaacgagaatcacttgaacctgggaggtgaaggttgcagtgagccaaggtctcaccattgcactccagcctgggcaacacagtaagattctgtctcaaaaataaataaataaataaataaaataaataaataattcttagcgttgggaggcaattctccataacgtttctataagtcatgccagactatattttctgggatatttgcatagcaaacagcctaggaaactaaagatagtgttcccctgcagatcagaaggcacatgtgtttcctgactagcatagtaaagacagagaacatcccctgcccagagatcggtttacattccagggtaataagctttattaccctggaatcagccgtctctggaggggaggataggcatgtctccttataaaattggggttttctaaagctcagtgttgctcagctgtgaaacagacccctatgtgcacagtatccacctaggcccacatccccatcacctccatgagacctggggggccagggagaactgatgatgcagacataatgctcatgctgcctgatgtaccacgagtaataaactagataggtacatttgggttcattatttcctttccagctgatctagtagctttctattctaagctgctccttaggggctgcttggccacctgacccttagaagcaagagttcgaagatttttcacttttgcgtatgccattaaaatgactcaactatttccatagattcttcatgtacatctttctcaccctgatgctatggtctcttctctgcttattgattctgctatgctatcatcatggcttctgccttctcttaacttggtcttgctcatggtcttttgtgtgcatccttgtagatttcacttctgactgtctgataatctttacttccaaaaccaaacttctgagagaaataacctattgggacaatgtgtccctgaatggacagggattttcaaggcaggccagtccctaggtctgccagtatgcagactggctccccttgagtcaggtgaccatcatgatgattatttatctgctgtttcagcctcaaacctgccctactacatttctctgtgtttcccctgcagctggaagtctgcaaacaactagctgtttcctattatgttgtatccatgggaggcagaggagggacagcatcaggcagaatacagagagacttttcttgcatttagctctaacttgtgaaaactgctgtagtagcagcaagggtaacggtaactcagaactccaaccatatcacccaactcagcacaacattcaccccagtggatatcaaggtacactgcaaacataatgttttacacagagatccaagattggtatcacatctctctttttatatttatttatttatttttgagatggtgtctcgctctgttgcccaggctggagtgcagtggtgcaatcttggcttactgcagcctctgcctcccaggttcaaacaattctcctgcctcagcctcctgagtagctgggattacaggcaagcgccaccacactcggctaacttttgtatttttagtagagacagggtttcaccacattggccaggctggtctcgaactcctgaccttacgtggtctacccatctccgcctgccaaagtgctgggattacaggtgtgagccactgcgccctgcctggtgtcacatctctaaaggggtcatggcatacccatcgagtagcactgacaaccaaacaggatgcccctttgcttatctagaacactatggaatgtggtcagcacagaaaggagaaagtgcagcttacataacgtacacatttcaaggctgcctgtattcacttatgttgtgccagggctgacaaattgactggcatagggctataccattacatgccaggggctcagaattgttcctacttattctggaaggactggtaacttacacagactaaaagagtgagacatgatgtttcaagtgataatatctagcggggattttagataatcatggctcccacggtagttttagaaaatgtggatactgccgcctggtcttcttcctagccattttgagtttgctttccagcttttcgctggtgcttcatactcactttttgcactggcatagccttttgtcaaccgtatttccatttacttctcctagtccgtctttccctttcacttgtggttttcttcccttgtcatttaagcattctcaactacacatagaaatccaacagaagccttttgtgtgggggattccctcagtcccaggcagtcctgaaagcagcaggtgtctctgcaaaggcttctgtcagaccttagacttatacccagcagctgctaatcctgagctctcactcttaaaaagcagtaaaatagacttcagtcaaaaacaagtatggtgggagttaactccctcatcttgagctcaagccacacttgccttgaaattttccaaaaattcactaagctaatttctctcactatggaaagagagaaaggctatgttgctggtatacaatgctgcctgtgatggaggtggtgaggcataaatttccctaatcggaagataaaggctaaccacgtatgtgggtgatgggggttggaggtagcttccagggcactggagctacaagtagaagcacaaattttcctggctggaaacaggcccctagagggaaacatcacaccagataaggaaataatctttttttttttttggtccaacagggcactaaggctcattatcatatgccaagtaatgtccacctatacaagaatacacaaactaacttcttatgttattaacacaaatgtatctctaaaacagtcacataagctaaaaaacaaaacaactattaaacttgactttatattgtttatggattcattcacatatatagtaaatattctttaaggtggtgaaacaagatattaggacagctacttaaagttcaaaagagccaatgtgcctcttttgcccactgttttgaaatggtgatgcagccaaatttcaatccatcaacacacttcccctctgcattgcacacacaaagcatcacctggctgggcctcttgttcgagctctctgtaaaaacatagaattccatagcattactttaacagcatatggtccaatccccctactacagatgggtgaactaaggctcatgccttcagtgagccaacaggtatagaggacctaccacgtatcaggcgaagttctagaccctggggagaaaaagatgaatgagacacagttcttgtcctaaaggtgctcatggtttagtgagagagattagacacagacacacacactcacacccctgcaataaaatattaaaagtattattatgtgtgtttgtggaattatgagattccttgcagattaagaagcaactaatagtgtttgagagagggactcaagaagagtttcccacaggagatgagatttgaatgtgggccatttaaagatgaataggaatttgtctggtaggagacaagaaagggcatttgaagcagtggaaacagcatgtgcaaagacatgtagtgtgaaagcacctgttctcttggggaggaacctagggtggctcaggagctgggagtaaggagtgggagaggaggtccagatgggttccttgacttgccgtaaggtcctacagcaaaacaactccaaagcccacctaattaggtttcttgactctcactccagtgctctttacactggaccttgatgcttttagcaccaataaaatgtagccacgtgaaactagaatcatttttaacataataaataccatcgatgctgtaggcacaatgggtagcttaaaagagggtctgaggaaagcccagaaaagcaaattcgaaggagaaatgtaacaacaatgacacctaccagaataaaaagagtatttatcaaagccctagatagcacatcatacagccttttttttttttaattcagaaaataaaggataccaggacagaggaagatgataataatagtgataataattgcaacaaacggtcctagtgtctcatactttaaaaaaatcctcctttgtatatattatttcttcggaacgatgagataattatgtagtttggttaaaattaatatgcaatccataactaaaaagaagaagacatattatttacaactgttcatttgaagctatcactgttgtcaaaatataaatcagatgccttcatgatgaggaatttggcacaagttccacataagccagaaggttagaaaaagagaaaaaggaagtgtattcatgctattcactaagaaaaaaaagttttctccacagatgatgggaggctttgaagttgtgcaagagagcacagccaccgacaaggagaaatgagtgtgcagtgtactgttacagcattttggggcccatgttgaatttgccataataagtctattttctgtccaaaaaatggtcaaactttttattttcagagattaaaaaaagacatatatctgtatcaaccattctttttccatattctaaattagaaagataattccttaaaaatcaatataggtggttgggcacggtggctcatgcctgtaatcccagcactttgggaggccgagcaggcagatcacaaggtcaggagattgagaccatcctggctaacatggtgaaaccccatctctactaaaaatacaaaaaattagctgggcgtggtggcaggcgcctgtagtcccagctacttgggaggctgaggcaggagaatggcgtgaaccaggaaggcggagcttgcagtgagccgagatcgcaccactgcactccagcctgggcgacagagcaagactctgtctcaacaacaacaacaacaaaaatcaatataggaatttgcctatgttctaagcacctttatttgatatcactacttttataggcatatctcttttaaagtcttgtctgagatacctaaatggaaagtagtttactcacttcgctgctcaaattgagaatccttgtagtgaagaagaaagaattttgcaaatgagatttgagagtagagagggatgtccatgacatcttaagagcaaattgcagggtatttgcacattgctgtttgtgcctgtttgtatgaggaaggagaaagttgtggaaaaatatgagccaatttgtggatgctggttcccactgtggggtaaaaatgaagggggattacggaagagattaacttttttcttcatatatctgcataaggttcacactcattataatgatcataaaatgtcacaattttcctttaattgaatagaaaagattaaatagaaaaaacttgacaagaaaaataaaccctaagaataaagattttttaaaacactaaagaatggatttaccaagcattccctgagcaaaatgtattccacagcaaagaaataggcccaggtatcaaacaggtagtctgccagcgaaatgctgcccaagtgactctcaagatgaggtctacctaaaggttttcagaaatgaaattcatctagcatctagcaccataaattagcagaccaataggatttaaccatttaccaaaactgcatctgggaactgataactgccaggcatcatgctagcaggtttacagcaattactaattgcatctggagcagaaggtaattaactccagttttagagctatttgggtttaatgtactaactttctgtcatgaagctgacagataaaaagaaactaagtatgaagcatgctttcagggatatgtctccaatgtttgggagtctgtgtgggtactgcaggggaaagggcaacgctttggaacaaagcaatcctgcatttaaattctggttcagctattatttgctgtgtggcctggacatatcccttaacttctatgaacgtctgatttctagggtgcaaaatggggataagtattcctatcttacaggctgtagaaggaaatgagtaagatcatatactaagctacttagcagccacacttggcaagcaatagacacataataaaggaagctattattactaaatcattccagtacaccttgatcaagagtgggctcactctgctcaatgtatgtaagaacatacatttgggattttttgttttgtttggttttttgagacagaatcttgctctgtcacccaggctggagtgttgtgggaagtcagggaccccaaacggagggaccggctgaagccatgacagaagaacgtggattgtgaagatttcatggacatttattagttccccaaattaatacttttataatttcttatgcctgtctttactgcaatctctaaacataaattgtaaagatttcaggctggtcgtggtggctcacacctgtaatcccagcactttgggaggccgagacgggaggatcacgaggtcagaagatcgagaccatcctggctaacatggtgaaaccctgtctctactaaaaatacaagaaaattagccaggcatcgtagtgggtgcctgtagtcccagctactcgggaggctgaggcaggagaatggcgtgaacctgggaggtgaaggttgcagtgagctgagatcccgccactgcattccagcctgggcgactgagcgagactccatctcaaaaaaaaaaaatttcatggacacttgtcacttccccaatcaatacccttgtgatttcctatgcctgtctttactttaatctcttaatcctgtcagccgaggaggatgtatatcgcctcaggaccctgtaataattgcattaattgcacaaattgtacagcatgtgtgtttgagcaatacgaaatctgggcaccttgaaaaaagaacaggataacagcaatgtttaggaaaaaagagagataaccttaaactctgaccaccggtgagccgggcagaacagagccatttttctcttctttcaaaagcaaatgggagaaatatcgctgaattatttttctcagcatggaacatccctgggaaaaagaatacgcacctggaggtataggcttataaacagcccccacccaggtgcacctgtctcttatggttgagactgcaggggtgaaatagaccccagtctcccatagtgctcccaggcttattaggaagaggaaattcctgcctaataaattttggtcagaccggttgatctcaaaaccctgtctcctgataagatgttatcaatgacaatggtgcccgaaacttcattagcaattttaatttcaccctggtcctgtggtcctatgatctcgccctgcctccacttgccttgtgatattctattgccttgtaaagtacttgatgtctgtgacccacacctatttgcacactccctccccttttgaaaatccctaataaaaacttgctggtttttgcggcttgtggggcatcatggaccctaccgacatgtgatgtctcccttggatgcccagctttaaaatttctctcttttgtactctgtccctttatttctcaagctggccgatgcttaaggaaaatagaaaagaacctacgtgaatatcagggcagattccccaatactggagtgcagtggcgcgatcttggctcactgcaacctccgccctctgggtttaagtgattcttctgcctcagcctcctgagtagctgggactacaggcacgcaccaccaaacctggctaatttttgcatttttaatagagacggggtttcaccattttggccaggctggtctcgaactcctgatcttgtgatctacccaccttggcctccctaagtgctgggattacaggcgtgagccaccatgccctgccaagaacatacatttgtaacagtgccacccctccccctattccacataagagttgtggtcatgtgacaaattttggatcctgaagatcttgttaaaatgcaaattatgattcaacaggtctggttcaggtgatgcatgtgtagtgaactgctggtgatgctgatgctgctagtctgtgggccacaatcagagtggcaaggttcttgggaaaaactgctatatattaaaataaaatgggccaggcaaggtggctcacagtgtaattccagcactttaggaggctgaggtgggaggatcacttgagcccaggagttcaagaccagcctgggcaacctggtgagaccttgtctctacaagtgatttttaaaaatcagctgggcacagtggcatacacctacagtctcagctattcagcaggctgaggcagaaggatcacttgagccctggaagtcaaggctgcagtaagccatgattgtaccaccacactccagcctggtgacagagtgagaccctgtctccaaaataaataaataaatagataaataaataaataaattaattaattaaatgaatggagctgagggagtcaggagggaccgtgaggcagggttagctactccatccctgttcctgcatgcctgagggacatttccaccatagctcgtgccacactgtattagttttcccatgcctgttccactaggctgggagctccttgaagacaaggaacccatcctgatggccccaagggactgctgaattcaattcagacactcaattcaggctatgtgtaaacaaatgaagaaagtaatgaatccatgaatgtatgaaattcatgtaatgaatgaaattaagggaaatgactgttggttagtgtattaaagtctaaatgggttcaaacttcctgtttccgaattactggactaacttcatatattaccagtattgagagtattaagtgctttattgtttgatatccaggcaagagaactatcaggaaagattaatcctggacattcactttagaaagataaagtttcaagagttccctttactgtaacacacaaaagaaagacccagaactcccttttctcaagggacatctcctatcctggaggaacagtaagtacagttcccagcatatcactaggacaacatcatttacaaaacaatcatgctggcagcatactgttataattagcatagattctcttctaaggcacatagaagcgttatctctctatgctaatcactttaaaggttctgtaagcaatatcactaaaaacgagcaaaaaaactctcattacttgtatgacaaaatacagcaagtattccaactgagttgtcacatcagtgtccatttttacaattaactcatgctgtgtttacatgcttaatcctactgcaggaacaagtggagattaagtttgccaagtaaaccactatagcaaagtctggttttattgccaggagatagaaacctgttaaactcagaaggaccactgaaagtgttaagtttcaatggacagcaataggaagcacttgcccaaacgtgatctatttacatagcatgcattcttctgatcagactctcaggttattcgattggtcagttcagggcctgccttcctatggctcttttgttgcaaagtgggacgtcacatgtaaggacagtataatgtcaacttctaaacttctccaggtacatgtaaaagtttagttctacagcctaaatattaaaaaatatggatgtggttaaccgtggttcatctcaatagaataataggactccaataaatatgaggcattccatttaaaatagggaaactgtaattaggtgtgttttaaaatttagctctggtttaatcaagtcagcctaagcagtccaacatattagtctttgtcagtaaaggaatccatccactctaaactctccctgggcttctgaagaactttaaaattgttcattaattaatgctttcagcactcctacagcctcattatgctgttgttattaagcattttattttcttggtcccaagggttcccaaagcaaatacatgttccccagcagacatttatgttttcctccagaagagttggttttccattcttgatctaaaacaaatgttaattaaaacgatggttaatatggcccacacttttcccaaacattttcaaagttggcagcattccattctcctcttcctatattccaagaaactccagcaagtgattagtcttcttcatagagtaaaaatatctagacaaaagcagtcaaagaatattctgagtagcttcccagaaagatattcttagaaaagctccctgtttggggctcttatacatcagagagcttcaattcctacaaactttgtggaggttactttaaaggccaactaccttttgactcacaaatcacttctgggaaattttcctaaggaaaaagcatagatttccacaaagcttggatgtgaaagcttgtgaatgtctttatcacaacattgtttaatatttaaattcagaaaaacctaacttcccaaaaatcatggagtatccatactatagaattctatatagacatatgaaaagctttaataaaatatttaaggatattaaaatatttatgatttagtattatacaaatataagaagacaatgagaataatttctagaattatcacaatttcctaaaaaatatatatacatatttgactgtaaagaaataaactcagaacttactaataattatgtctagtttcaggtgattttaatttcttttctgtactttcctaaatttttgtagttttatatgttctaaattaaatatatattactttgtaattaaaatataaaatgttttacttattcctttctcttagcaatgtgaatatagtcttcctacatggggaattaatcactagattagtaggaaattaatgaaattaacaatggatgaacaaaaagttaacttaccacatacatttggctttaacttcttgtatgtaaataaattcctcccagtagattctctaccaactacctccagtttctattagctgatccttgtttagaagcagtccactgatttttagtaaatcaaaatgaaactccaagaaagacaagaagatgaaatgtgaaaaggaagctggccttggtgctatgcacagtgatggaaaccatgaatatgaatagatggagcattcggatagcaggataatagaagagggaaatgcattcatttgacagctgccaactccccctccctgcactgtcacttcccggctgcccacccccttctccaggccttgattcccagcccacagaaacgccgtggtgcgtgtagcctctatggtgttctcacactccaaaagcgcagaaaataaaaggccactatgttgaaagcttgtgcctcatagagtaacaacagtgctaaaagtgcttaaaaatacgttactacttttcatatcaatcacagcgttttccaagctactccccaacctactgtgaggtacaagggtgagcattgtttaattggctttgggagtcgtatgagctgtgcgagacctttaattagaggagctggtggaataagcgtgtgatgtgtgtgttagggaggggtgggctggttctgccatggtctttgtaatccctttgcaaatgcacctttggacaaacttaaaagaaagtagaggaaagttagaagaacttgcttcttactaaaagaagttcaaggtagcagtaccctaggttttgttcatgtgcctaatctctgaattcaaataccacttaataatgatgcttaaactgtttattctcaatgtcagaatgttctcatctaggtcaacagagaaaaccctgatttgtagtactggggtctcatcccagagactgttggtgctgaggcacatgcaccattgaaaggggaaagttattcagtactagcagcagttgctatgtagagataaagacctgacattgctggatcttatgattctttaagcgtaattggaaatctattttttaggtgaaatctgtatttttataggttgataacttaaaagaaaaatcaacactttctatgagcaaacaaaacatctctgtgggccaaaataggcctgtggacctctgattcaggaagaagaggatcttaacacaagattttttaagcacattttaaagtgcaccaaatttatctgtatatgcataaattattatccaataaattcagtagaaaagaaccatgaatttaaattctaaaccacctgaccaatttatctgaatcagctcctaaaatcattttgggtctattttcctcctttaattaaaataagaataatctactaaagttttacaatttaaatattgacaattatatttatttttgcatctcagagccactgctgatgtatttcttttatgtatgaagagactgaggaacaaggaaaaatcacagaaaagccagaggatgaagctggaatgcaagagtcctgtctctttatgattcaacaatcaaataaaaaccttctctaaaaaatgaccaagaaagcaagcttattaggttcatgaacagagtcatcacgtaaacaaattacttctataatagtcccagtaaaatgatctcaggttcttatttaaaactcatggaaaggaaatatgtcaggttaagacatctttatctgtttttaacaactggaatattaatcatatctaattcaatgtatatttcaaaatgagtaactcacatattcacagcactgtccaaattaatgaacaggtcccattacctaggactcatactttaacatttactaattcgctttccacactgccatttctcgttagaatggcaacttctagtttgtgaaggaaatgagtcattccatgcaactatcccaccttctgaaggacaagtcacagcaggaaatgaatggcttttggtttttttttctgcactagtacagaaaaacaatgtatctaatactgaaggatctgaactttgggacaatcactttttctagatattgtttgcaactttcagaacattcttataaattaatgtaaattagaattataattttgccattgtgttatgttgaaatgaaatctacagctatcactaaatgtttatgaattttccatctacaatcaacctttcaattagtcttatacaaagtcggtctcaagttagatttctggtttttacatctaacttaaatgcatcttgtggttaaatgctgtggaaggtttgactagacctcagaactatcaataacttataaataatggttaaaaatcaccattaaagtgtgtatagcagaaacctagaactgaaattcacttgaattgagtctggttcaccttatttagtttcttccttatttagtttcaaattccctgtgctgggttggggggtggggagaaccctgtgacttatagatatataaagtgtcttgtgagaaatgcaaaattccttcgtaaaactaccttatcatgctgtccaaattatagaaagcacaaacaagtgtcctcacttagacaaaaggctacagtaaccaaaacagcatagtactgataccaaaacagagatatagaccaatggaacagaacagacgcctcagaaataacaccacaaatctacaaccatctgatctttgacaaacctgacaaaaacaagaaatggggaaaggattacctatttaataaatggtactgggaaaactcgctagccgtatgtagaaagctgaaactggatcccttccttacaccttatacaaaaattaattcaagatggattaaagacttaaacattagacctaaaaccataaaaaccctagaagaaaacctaggcaataccattcgggacataggcatgggcaaggacttcatgactaaaacaccaaaagcaatggcaacaaaaaccaaaactgtcaaatgggatctaattaaactaaagagcttctgcacagcaaaagaaactaccatcagagtgaacaggcaacctacagaatgggagaaaatttttgcaatctacccatctgacaaagggttaatattcagaatctacaaagaacttaaacaaatttacaagaaaaaaacaaacaaccccatcaaaaagtgggcaaaggatatgaacagacacttctcaaaagaagacatttatgcgaccaacaaacatatgaaaaaaaaacctcatcatcactggtcattagagaactgcaaatcaaaaccacaatgagataccatctcacactagttagaatgacgaacattaaaaagtcaggaaacaacagatgctggagaggatgtggagaaataggaatgctattacactgttggtgggagtttaaactagttcaacaattgtggaagacagtgtggtgattcctcaaggatctagagctagaaataccattttacccagcgatcccattactgggtgtatacccaaaggataataaatcatgctactataaagacacatgcacacgtatgtttattgcggcactattcacaataacaaagacttggaaccaactcaaatgcccatcaatgatagactggattaagaaaatgtggcacatacataccatggaatactatgcagccaaaaaaaggatgagttcatgtcctttgcagggacatggaggaagctggcaaccatcattctgagcaaactaccacaaggacagaaagccaaacactgcatgttctcactcatagatgggaactgaacaatgaaaacacttggacacagggagaggaacatcacacaccagggcctgtcatggggtggggggtggggggaaggatagcattgggataaataactaatgtaaatgatgggttgatgggtgaggcaagtgaatcacttgaacccaggaggtgtaggttgcagtgagccaagatcgccccactgcaccgtagtctgggcgacagagtgagactctgtctcaaaaaaaaaaaaaaaagtgctatttgtgagatagggatctacatgagcaatttaatgtacttccagcaagggaaagtagggaatcgaaactgttagggtagacttttgtttacttgacaaaaaaaagagaagttattaggcaaaaggaattttaaatattacagttcaagttttacctgtgtagtccttgatgctctttcaggaaaaaaacactcactctcaacaaaaagggcaaagactagaatctgaccctgtttgtccttccctttttttgccatcaatttgcctctcttatttcttccatatatacacgatccttctccctacaaatgtgacagatctccagtttctagtcatgatttgctaagcatagtgctgcatgctctacttacatacttcactgcctgttttcagatcaaaagagacaatgagcgaattctccatttcaaaaccacagcaatctttatatcctcaggtccagcactttaggacctggagtcattgatctaggtctcccacacaatatcaaaccaaataatacttaatactaattccaaatacctcttccctattcatatacttattttaggatttaatttatctttcactctttctgtgaagtctagggactggacagctacctcttcaacttgtcatcctgtacttagcattttacctctgaataactcacaaactacagtataccccaaaccagattaaaggtatgcattggatatagtgtttaagcacaaaaacacccatcagccaactgaggactgttgtgtgaagactaatgtcctgagatggccaagtacacatcaggtgtccctttcctccccaggaacacggccagggcagccatcagctaaggagacagaagcttttctggcttcagaatctttcttaacacagcctctccaggcagccactactgaagggtcagacttggtcctccagatgaaaagcttttgtcatgtggcctccaagccctcaatccaccaggatgcccaaactaaattcttacagatgggagtatcttcagtctttctaaagagaatgtcacaggaaagtaggcaggaatctctttttatccaggttttagcctaagtgttaagatcagcaattctaaaacatggtgtcagccctttgtgacaaagtcctctattatcctgttcatctccctgctgaattcttagcaacctctctcagagatctgcagaccctttttcttgggggaaagaggtagtttcccaaagctgtaagtgttagttcagagaatgagagatgctgacttcattgtttcccaattcagtgaagcaggagccggacttcaggcatctaattctcctcaaataaagagctaggggtgactagactggaggaagaacatgacacacgtgtgaggtctaagaaccagaagaaaaaaggagggaaagggaaggactgggagttgaaaaaatttcaatttgcctttacatggtacctatatttcactagaggaaaaattgaccacgaatgtcaaatgtagtaacttttcatttcaagttcttgtcctctccatctgctccaattcagagcccaaatgcccgaaaagggcaagataagataaagtaacgagaccatcaacttctcgcaaattaataagttaccataaatgaaaatcaaagtggaggcggatccagccccaactggctgctgttctttgggaaggagaggtggccactgtcctagaaggcggccctgccttctccgtcagcagcagcctcagtcagctctcctgcgctcctgtctcttcttcctgcatactctgccccagattctgacttgaaccttgctaaaatactgattagccctctgtaaagtttggctgtccagtggcaccagaatcatagaataatcagggtagtggaccctgtaatgtgccatcagattcctttaggactagggcatttattctcccagttgggagtgttagaggctggcagctttcagctgagggcctctcaaagaagcatgcttagttagagagagccaccgccctggagggagtttgccctcttgggattgggcaacccacagccaatgactggctgatggagaaacataaaggccttgcccccttgccttaactcgggaccactcttcaggctgtcccggctccagagccccctgtgcatcacagccatcttctccctctgttccgttctcctgctttcattcccctgccagtccttgtggccataagcagtccctaatgaacctcctacttgcaaatcacagggtctcagagtgagattcctggataactgaactgtgaccatcagacacaaagtacaaatagtgcttcatcatcttttgctcaactttaaattcatacattatttactgacatccctaatgcttgcatcagccacatttatacgttggtattcagcaaacacaagaggacatggctaggctgcctgtcccccagtccagtgataacaatgctactgcaggatttgcaccatgattttaaaagatgcagtcctcattttgtgtggttctgatatgcacccatttcagtgagcacaatttaaatgacacccatcctacaacaaccctgttcaaatttcagttaccacaagatattatagtagtaactgaatgaagtatgctcttcagcccacactacaaaaatgacagatgcatagcacaaccagtggccaatcacatcacttctttcaaagactgtcagtgactggcctggtcactgcacatctgagcagtagagtgatacttggccctggggcttggggagataaaggaaggacagcaagaaagcagggcacactagccagagggtggttatggatgacctccttgactatcagagtcctgaacaggagcagggccttagaaggggtctggaagcatgtcaatccatccacattcaagcacaggaaaagtgggaccaatatcaaacctcattattcatttcccacccctactgtaacacattaccacaaacttagtggcttcaaacatcataaggtgattttacagtttggaggtcaggagtctaaaatgggtggcaaggctgtgttactgctggaggttctcagggagaatccacttccttgccttttctagcttctggaggctgcctgcattccttgacttgtggccccacatcactctgacctctgcttctgtcattgcatctcctcagactctcgcttgcctgcctccttctcataaggaccctgtggctacacttggcccaccctgataatccagaacaatcacccatctcaatatctttagtgtaatcgcatacacaaaatttcttttggcatgtaagataacatattcacaggctttatggatgagaatgtggacatctttggggagctattattttacctaccataccgcatcatgtttttgcaaatgactggtgttctcctggacaatgtcctgcattcagctgctagaatgacagggctgcctgcaaacatctgtgtccgtacctagacctccccgggaaagggcaagagtgaaggaatgacggcctggtgttcctgccccaaatcagcttttcccaaagggctgcttaagactctagtccctagatacattctacattaaaacctaccactttcccgtgaatgtgggaagtactgcattcacactctccttcttggacactcacaattcatattagcataacaaagatcctgagatgttctgcagtaaagaaatctctttgacttgcttaactctgagttttctaaatgtattttcacataaaataaatttaggaagaagttgggaatgctgtactagcttatattccaactctggccaatgctgtgcaaacagttctgcatgaagtccacagacctctcaggccctcttgaaagcttaatgcatgaagctgtcttaccagaattatattaattctcctggagtggtttcttctcttgcaccagcccttggatgcactttggcaaaccctgaaactgcctattgactcacacgtgcaaagtatatgaagtgacacattcttcaggtgtctcagctctgcctggaaactcatttcccgtagagccattttttccccctctctcttccttctctttgactctggctctcaaaactaaggggaaaaaaatgaccaggaaataacgtgtcaccaattacacgcatgggcttttacctttctctctcttagctgtcaaatcaaatgcctgggcagattgccacatggaaactaaaactctttttcatttagcaaatgaggtgctgttatcaaaacagagaagcattgccttattgctggtgtgttccaggctgcagctctggatcgctactgcagtgggatggttgactcacaagtttttcttgggaaccactggaagtcttggaggaaccacagaatctcaaacagaaggaaacttagagatcactcatttaaattttcttctggaatcctagactctttatttaatatccccaattaagaggcttttaattcatgtttaacatattttacaaccatcatctatctttcaactactactcacttgaacaaaacttccatcctagagaaccaggtaatttgccaagcccataccaggctatgtacctcttgcctgtgtctgaaatgtctcctctcatctacccccatttttcatcatcacaatagccaatatttattgtatatgttcatattctgtatggtaggcactgtgccagaccctttaattatgtcaacttatttaatcttttttttttttttgagacggagtctcactctgtcacccaggctggagtgcagtggcttgatctcagctcactgcaacttccgcctcctggatttaagcaattctctgcctcagcctcccaagtagctgggattacaggcacccgccaccacgcccggctaattttttgtaattttagtagagacggggtttcaccgtgttagccaggatggtctcgatctcctgacctcgtgatccgccagcctcggcctcccaaagtgctgggattacaggcgtgagccaccacaccccggctaatttttttttttttttttttttgtatttttagtagagacggggtttcaccatcttggccaggatggtcttgaactcctgatctcatgatccacctgccttggcctcgcaaagtgctgggattacagggatgagccactgcgcccagcccaacttatttaatcttgaccatagtcttatgatgtagtattgctgctttatagacaaacaagcaaaattatttactgagttttactgtgactgataccatttgctgtgtgccacatttaagacactgtgctaagcattttacatttttatcattgtgtctatgagtcaatgttatgattcctcttttgctgatatagaaacagaagcttccatatgatgagaaattcatccgtggtcatacagctagtaagtggcagggctgggatccaagtgcacaagtatcttctattcatacttcactcctaccttcttgttttctttccagccagtgggatcctccgtgtatctcagaattcatagagcacttacttgtcagcccagtcttgttattgtcatattgtgcacagtagctactttctcctcactggacatctcttacggtactttgcatcccttaccatggtgcttacaatgcgcactccccaaatgtcaactggtctagaacaagtcttcttacagcaaccaggactggcatggacatttttctgatgagggatttccaggtctcagttgatttcttggttatttcaggatgcaactatacaatggcattcagtacatggaatttaatgcaatactttgtcccttgatgcttgttttaacagctacagaaggagagagtgactgttaggctgagtcccctcagacctactggggtggctaagtcgaaagaatctctaggagtcagttatatctcaacatgcagcaaaatgcccagcacaaagcaggtgctcaaaaaatatcttttgaagaatgaccatttacaaataaagtcatgttctacagactgtttaaaaacgatgatctcctttcatctctgaagtgattcttagaaatcattcatccagaaggtttaagttcttcaagcgattaaagctggtaattacaataattctattatttttctgttgaaatggatttagcacacagatgagtttttgtttatctgttttgtttttaaagatttcaaggtaactggttaggaggtatagaagagggtaccaatagtgaattgctaaattgctgcaaccaggagttctgcagcattctgggggaccaaaggaattcacttgggaaatacgactttctctgtgatacgtactcaggatatcaaaatcctatggacaagttcctgaagaaagtattccactgatatgagaataatgcctttgggctaaaacatactgtcttttgactgagtttcttgaaatctctgtactaaatactgatactccacaaataataaaccataacaagatctaaactgaaaaggttttataaagtatcacattaaaaaaacgcaagggttgttcagagtctttttcatccattaagacagaagcttctccagaagctgaggaatccacgtgtagggaccattcaagaagtcctggcaggatttggagaagagtgaagaggcagtttccctgggaacatggctgaagcacttccagaaaaaataaactcagggggcctacatcaccaaaggcaagaaattaaaactaatttttttcattttgaaggctatttttctaaaactaaataaaataaattgaagtatattaaaatattaactcacacacaaaaaaacgagtgagataaggtgtcagatacccctaataaatgcaagtgggaaatcaaagggagtctcagacaggcaggcaaaagactatgctgactttaaattaagtttgtccccagacagcgatttgtagacagagaaacaacattaatgttatgcttaaaacaatacagtaaatcacccagtctaaatattgaagaaaatagggcccattgaggctgttttccaaggtcaaacacttcattagaatagaaccaaggtctcctaaaatgctaatccttccactactcctgggaaagcaaacagctccagttccagttgatctgtctggaacaactggagaaagcaaggtatgggcagagcaagactgagtgctgtcgtcagttggcgatgtctgccgtggcattatggaaagaatgatcatccacatgccacagatctgccactctccagtgtaccatgccaccgtctaagtctacagaaaagccagcaaaattgttgagtgactaatacagatgcttttagttttcttaatgctcattattcacatgtcatcccataaaaatacataaatatacacatacattaagagatactgtaactttcatagttccaatgccaagccttagtatcaacacatatttgctataggaaggaagggaggaaggaagacagggagagagagggagggagagaagagaaggagggaaggaaattccccaaatacttcaagttccccaaatttaaagaagcatgaaatgaaattatcagcccaacaaattaattaattagtttatttatttatttttacttgagacggagtcttactctgttgcccaggcttgagggcagaggtgcgatctcggctcacttcaacctccgcctcctgggttcaagcgatcctcccacctcagcctcccgagtagctggaattacaggcatgcaccaccatgcctggctaatttttgtattttcagtagagatgagttttcaccatgttgtccaggttggtctcgaactcctgacctcaagtgctccacctgcctcagcctcccaaagtgctgagattacaggagtgagccaccatgcctggcctgttttttgtttttttggaggttttttgagaggagtctcactctgtcacccaggctggagtgcagtggcacaatcccggctcactgcaacctccacctcctgggttcaagcgatcctcctgcctcaggcccctgagtagctgggattacaggcgcgcagcaccgcgtccggctaatttttgtatttttagtagagatggggtttcaccatattgcccaggctggtctcgaagtcctgacctcagatgatccacccacctcgctctcctaaagtgctgggattataggcatgagccactgcacccagcctccaacaaatttatgtaacagatttgagtaacactatgtacttaactaataactttctgttcaatggatttgaacacatctttctccagttgttccaactttcagtgactcatttgatgaaaatcaagaagcttatgtggtaatagaaaaagagaaagggggaagacaacaaaaataaagaggacaaaaggcattttacaatataaaacatttgagtttttcgtatttctgttttgtttaaaatcagagaaaacactgaaattatgatgtgatcattgttgctgcttatattacctaaccaagagtaactgtgcaatcttccagtctgtagtcctccctgtattccatcttaatttggatattggatttcttttctaacattgtcttctttgtatgctctatttagatcagtgatacacaaagtatgttccccaaaacattaattcctcaggatattagtaagtgtgatctttttaaaagtatgtagtcaaataagtttattatattataggttagaccagtttaacaggtgccttgctgcaagatattgtaggcttttcatatactaacatatgctgcaagtctaaatatatatggtgttctaaatttctttagctacaaaatctttcttttgtggagcttttagccaaattagtgtttcatggagccaatgttgagcaaatggatttgaatactgcttcatctcaagatgctgtactgaaaatcagtccatcctctcttttaatcacatgatgctctggtgctacccacagcctgtctctccaccaggatccaccaagttccacacagtgggggtcaggagatactccctgaagtctactgcagagaccttggcaggtccctggctcttgcctcttctcacaggggcattagtgccttttcctccttttgccacagaagtcagaaatgaattccagccacaccctgggatcatatttgccaggtcccataagtcaggtcaagcggcagggactcataaacagtttccagcagctaaactgaccgcatggagagggaaagaatctcactctccacaggcagaagaagggacccaagtgtgtttaactcatttttgtcagaagccaggaatctttaaaagtctttctcaaaaaagctatttttgagaggttaaggtagtgatgctattaggtaaaacattttcatctttgacaaaaaaaaaaagaaagaaagaaaaacatgagacactcagaaccctttattttatacttaaataacagtttaatagaaaatcaggcagcctttagttcggtgtgaactttgccaggttatgtactttttgcagccttggttcttcagccataaaatggggataaaattgtccatcctgcagcattccgtcagtgataaagtgaaataatgtattcaccggtaacactgtgctcaatgcatgcttcatgcccagttcagcatcagctgcggatgttggctcctgtgagaaagaagctccatgggctctgctttttaaagaaagcaaatgacggtaccatcctaccaaatagatttcttccaaggaaagtatgttttttttaaaaaaaatagcaaattaatcatttagcttcttatttatgtagccttgaaaagaatttaaatccttcatttcaacagtacttctactctttcagaaaagaaatcactagaaagctgcctatggctgacaactccaatcctctccagaaggattttttttcttttaatctctattgggcatctataatgtgccccattatgccagcccaaccccctgatctaacttataccagtctcaatgcattttgattgctagattgtttttctaaatagatcagagatgggctaactgttcaccaaactattccctctccttcctgggcacctgactacatttcctggcatccctcgcacttagctgtggccatgtgactaagttccagccaatggaatgggactgacagtgttgtgtgtccctctaagcctaaccatataaccttcccatgcacactcctccatgctcctgcccctttgctccagcctgacaaagataaatcctgcaagcctgataaaggaaaccacatggaagatggcggggccacaagagggaaagggtctatgtccctgaccactgcttataagagacccaactgcagctcaagtaccctggttttgagctgggtacacatgaggaatgcttctatcatgtttaggccatcctataattttggatgttttttacagtagctggtgtctgaagcatctggaagtcctgagatttttgcagaacattatgagattatttataaaaataataaatcgaattactgtgtgccaagtccgagactcaggcactaactcataaaataactaaataatctaaaactaaggtatcattataaactaggttctactctaagtaaaccatcagagatgccaaaagtttaataaaaatattgctgaaggttgaattttctatgtttcaaccttaaagtatagaaaattcatttcatttatttagtttttctgtgacacaagaaaggctagcattgcttgactccagtagcagggacatcttgattcaccctgttaaacactactgtttcatgggtgtatagtttgtgtcggagaattggtgcagatagacatttctgagtttttgtttttaaatcaaattagaattggcattgtcagctctaggctctcatctacatttagtaaataatagattaggatcactttttttcacttcacaattatatgattatattccattatgatttgactgtagttatccatggtttaaatcaatcatgaaaaacattattttatctaaatatcataatgtataggaatatgcatttgttctatgtacacacaggaaagtacatcagggtatactctaagaaatttaagcctcaggccaaacctgggaaattcaagcctcaacctcaacctaagaccaattaagtaaattatttatatcattggctaaagtataagggagctaacctagtttaaggccatccagtgaaagatcaaatgctaaatgagattatttactgattaccaaaaaactatcatgttaattcagtaaagatctcataatcaaatacattatcaatggtacttctggaaaactgcctttggtgatcacagatattaacctgaacccaaatataccctaagtaacgtactaacaacctacttcataccagtcttattttttccatctctactgctcccaccttaatctaggtcaccatgactctccccaggcctactgaaatatctgccctcaacctggcctccttgcttctactctagccccttctccaaactgtacccctacaaggcccccaaagggatctccttcaagcacacatcatatcataccactctcttgtttgaaactctttcatacgttttaactggtcttagaataaaactggaactctatcatggcttgctgtgccctgccagtcccaacctatcctagtaccaacctctccattcccttcactccagcccaactaatctcctttgtatcccttaaatatcccgagctcttcccatcagggcctgtgaacttgctgttccctctgtccaaaatgctcccttccagctttgtacacagttgactgctcttcacccttcaggtcttagctcatccatcacctccccgagttaccttcttgccctgtttatttccttcatagcacttataaagcctggtaattttgttattgtttgaagactgggacacactatgaggacatgaagtttccctattcttttttactacctgtgtcaggcatcatctccttggagatgaaaggatggataaacagatggatggatggatggatggatggatggatggatggatggatggtgggtgggtggatggatggaataaacatgcagtagatactttctgaattatttgacccaacaactggaaccatccatgagaaaccgtattatcacatttagcaatgagtgattctggcagggatgtatatagggcaatcccagtttctcctgaagtacatctctcctgggaatataaagaagctttaactctgggaccattcatatggctctttccacatggtgagttctactcttaaaggaaaaatactcaattatgcaaaattgataattccaagaggatagcccagtatttaattagctataatatttggaggcataaggctatcctggtttttaattttaagacatccaatttatgaagaagctctttcagagaaaataaagtcaactcaacgcagaataagaccacaagctcaaaaaaaaaaaaaaaaaaaaaaagaccacaagttgcttccttagattcctatatctggaactattcctctagaggagatagagcaaatcaaacctctgacaatgtggaaatccagcatgcacttcatttttgtttatgacactgggtcaatctgacagaatagttttgttttcccagttctgactgaattaaagagagttgtgtctacagattattttcccagaagttcctctgtatatataataggaaatgcaggatcagatctaggcaagggctctttaaatgtcagggcagtctttccacattgaacacccctgagaatgccaacatgtgtgaccatgcttttccccattttgggccatgatgaagaaatgctatcccaagccagcagagcagctgaactcttttctgtagctcaacatgagaaaaaccaacaacctctgcagcatgtctgccaaggaactgcatgcctgttggcaaggagacagcagcctacacagagggaagttgtaagaattagcccttccatgcatgtgctagtggtaactcctgtaaagaagttactagggtcttcgctcaggacatctcacggtgctccctccttgaaggcccacaggagaaattcctcccagaactcagtaccaagagaagctttccttctcctgaagacttagttttgttgttgcttcatttggccttttggatgctataaatactttaacagattatattatctctttgcttgtaggaagccctgagatttgcaaccctctacactatcgacattggacattatggcatgcattcttaacatttgaactgtgccccgacttcatcttgcttttttactgttgttttccctcaattctgatttcgttaactaatctttgttctcttgtatcatatatatttctataaatggtttcaaattattttgagaatgaaaatggctattaatgcataaatacacacagtggattttaacccaaaccctttacgacactagtcctgtaaaaagacaatgtggcctcagacagacctgggctggaatcctgattctgtggatttctagctctgtgacgttggttaagtcgctcaatagttcccagtttccatttcctcctctttaaactgaggctagtatcatgtacattgcatagtaactgtgagaattaaagagaatgtatctagagcattggcacttaataattgttaaattaaacttattctttattattattaatagctatacagattgttaccaaagaatacttaaagacaatgtctggcttatcatgttgacaggcttatgagcactaacactatctactcatataccacatttctctctaacaaagacctacagttaaacacttccatactagctcaatgtctccaagccattctttccaacatgctagatttgttgcaagatcctctccccattaaggctccctgtaccatatcccctgtcgtggattgaactgtgtctcccccaaaaatatactgaagttctaatccccaatacctataatgtggccttatttggaaacaaaagactttgcaaatgtaatcaaattaagaagatgtcatactggattagggtaggtactaagtgtaacaagtagtgtgctgataagaaggccattgaagggccacgtgaagggacacacagatgcatgaaaaatgtcatgtaactatggaggcagagatgatgcatctagaaaccaaagaacactaagtactaccagcaagtaccagaagctaaaagaggcaaggaaggattcttgtttagaggctttggcagaagcattatcatgatggcactctgattttggacttccagactctaggactatgagagaataaatttccattgttctaagccacctaagttatggtgatttgttatggcaaccctaggaaatgaatacatcccaaaactcctacagccccaagtggcagaagtaaagaaaccaggcaaacttgcagtccaagtgatgactgccaagaactccacacatacatgcctggcagtaagatgtatttcatgggaggcatatactaaaatagcccaaagagtttgaccatactcttcaatgaattaattcttctttctgagcttaaaagaatcacatcaacaggagggcattaggcctagatcaacaatggcaaatagagcttaactgagaatagctggattacagtgttatgttcaaaattctgtggagtcatctgggcaaagatgcagagacaaaacaaacaaacaaacaaaacgaaaaaaacagaaaaaactaattatccttatgcctgtgaccatcctctccagtttcctcttctgctgcccactgtaacatagcatattcttagggttctgacacagacccacttcattccattccccatatattctctttggacagacccactgattcttatagtcttaccacttacagcttctgtggataccttccaatctatctctcctggcagcatcagtcttctgctcttgtctaggcccatatatccaactgctggatagacatctccacttagctatctcagacaattcaaagcaacttgtctataacagaactcaccagttgctcccctaagcctgctcctcctcccacaggctatctctcagctggtggcacgatcatatacctagctagaaaactgagtttctccctagtctatttcctccttctcacccccgcctcccattccaaatcaatttccaaaagttgccaaccttaacttctaagtaattgtcttcttcttgatacctgctatcactctcctaattcaaactctcatcaactcttgccttttaagattaagactgggtatcactgcctccaggaacctctgcaagggactgtatttgtcttgttttcccttgtattcttggaatttggcattgtgtctaacactgtaggcaacagatgatgatgataactatcatttattgtccacattctatatttacacagttatacaattctatcaagaggtagaattggctgggtgtggtggctcacacctgtaattccagcactttgggaggccgaggtagattacctgagatcaggagtttgagaccagcctggccaacatggtgaaacccagtctctactaaaaatacaaaaattagccgggcgtagtggcacatgcctgtaatcccagctactcaggaggctgaggcaggagaattgcttgagcccgggagacggaggttgcagtgagcagagatcatgccactgcactccagcctggccgacagagcgagactctgtctcaaaaaaaaaaaaaaaaaaaaaaaaagaggtagaattactgaactgatctgatattcaatttagattaaaatatactcataagataaaatactgaaatgcatatctgttcattcaataaatatttattgagtgtacgctgtgtgctaaacaccggggataaaatggaaaacaaagaaaacaaacaagtaagtgagtatataaataacttaatttcagacatgggaaaaagtctagcatctctcaggaaacccattccaagcttcttctcaggctacctgcggggagggatgttggcaggaagaaaagagacccctccccacttagtccacccccttgctctagaagattattcctagataccacccccaacctcaggcattgttcagacacttaagaaatccttaaatttgcagcatgtgaatcctctgccaggctaagtaaggccaacttaaatttttctatcataatacctttctttgttcttcagaaatgtcaagaaaccttatgaccacatgcaagctgatggtaattaaaagaagacactgtcttcatctccacaacgccaactccttttaaaatgtttacccaagacaagaggacatttctgtccatcacccactgcacgctcatcatttcttcccaattacagccactcttggatgtgatctaggaaaaaaatccacatctattcactgagtaaagagaaggattattctggtaggtgacatccatttttcatgcctgccatctgaaattcttactaacatcctcagaagtaaaagccccattcgggctcaaaaggacccagggaaatcaacactgaaatgaggatatggatggaggctgttctggtcatcctaaaacagagagtaggttttactgatggtacacgtttatttactgagatacttattccatcatgctacatttctttttatcagggattcttttccaacagctcaaattatttctgggtgggaagttactacgtgcataatcttcagttgggctggaaaagacaactggatattagtttgtccaaagagcccctctaaggttgataaaattaaatgacagctacagggagcatcatgtacaaaaaagcagcaaaagggggtggtggagaggaatggtcttagaacttctcagcagttttgcctatacaggttattactgaatcagatttgagaactataagaagtcacacggcagtttttgattaaactaacatttactgtgtaagaagtgccacagatacaaaactaagaaagacacatttttcttctggaggggaagacatatgaatcaaccaagaaatacaaaactgtgtgacatcactagagtagaggtacgaaagtgctcatgatctgaccagcctcggggaatcccaaggagaatgcaccagaagtagtataggacattaaatggacacctaagttgccatctaccactctgttaattcccttaattttccccgacatctgactttgtcctctccatatccctacacaaaaagaaccaaaccaccaaataactttactgtcattaagacatggcttcattatcatcattcagtcacccaacaaataattattgagcacctactatgggccaggtgctgtgatagcctggctctctcacaggcgaggtctggtgagccatttatcctggacctcatatccataaagggctgataatatagatttttaatatcatctccaaatgatatcctatatacagtcacacagataaacttctaggattcaacctcaaagcatatcacaatttttataatcctgtattgccaattttaaaaatatacacccaagtcctcctactgccacccatggatatgatccaggtctctcctattccctatgagcatttaagagaaagcaaacaagccagttgttataccttccctcacagaacttattgcttagtagagagaaaggtatcaaacaggacacataccaaactgataactgtagttgccgcaggggaggagaggagcatgacatgaggctgagctgttaagcaaagctttcgcttgccctgaagtgtttgaatttttaccatatgcacatatccacagtattccctgaatagtcattatcagtttctctatcagggtcatcattaagagaagagccaagaaagggaccagaagacaagctggccccaaatgaggctgaccccaatgctgaggcagtgagaatgagtgaaacatctagttgccagaggtgactgcgtttgtctgaggataaaatagctgcacacaaccttgtgatgaccatcctctgcatgccccatgggaagtaccgctaggcctggacacaaggcttccttttcctgggctctctactgggctcaatcgcctaatgaccctacaaatggaacaatgtactttcaagaattgagtaatatggatgatcaatgtgttactctcgtcctgattcgaaacttgtcttttcatggagagcaataaatcttatcagtagatgccaaatgcccctcagctgaatcacagctatatcgtctagactgaaatgtctcatctccattttgccaaattctgccttgtccattacagttaatctcataatccacatagacaccacacaattccataaacaacagagcagcccctgctaaccagccctccctctgaggaaagcctgaacatgtataaacgatctcaagccatgccagggaaataagaacagatatcatggaaaccatgttagcatgtcagtgcatagcctactgatgacaaactcagcagttatgccagacgaatttaggagtcaaaatgtttccttacactgtcattgttttcaattttctgattatatttttgagatacattcaatacctctggctttacagaacagaggtatgaccagtgactgatcattcaataatgcttctaatcagagtgattatatgtgagtgtacaagtgtgtgtatgtttgtgtgtgtcagtattattttgttttagtatgacaggtgacctctttgccatgtacacttgttacgggtatgtgcacatgtaaagccagcatagagaaatgcaatcaaatgtaactctgcaggaggaggaagagtagcagaggaatggctctctgcaggggatgtcacgtctgagctctgctgtgagaggtcagtgggagcttgcatggtggatagggttgtcagataaaataaagacacccagttaaatctgaatttcagaaaaacaatgaatgactttttagtaggtatgtcccaaatattgcatgagtgttctatatttttatctgctaagacaggcaatcctaatggtgggagaaggacagatgtgtatgccaaccatctttccttctttgtcatgaatattgtcaatatcagcatctattaacgtttacagaacatggggaatggagtccttgctcttggggaaccctaagaattactcctcctgcctaaaacactcagaacatgcctgcttcttcaaccacagcctcctcgagatcatgcactacaacttattcctccttcttcaggacctaggccagtgacggaaatgtcataaacacaaaagtacatttttagataaatgagaatataatatggaattatagtaaagggaggaaatttggggtgagagggctaaagatgacaaaactgtgcatggctgaaaatacaggcaacttcaagacgaatgacaatagccaaatgtgcagccatctccaacacctatgagcagaactgaacaatcttttagcttggttagtatcattgaactgtctcaaactagtgaaaagtatactaagcaccacgggcaatttcagggaagaggggaatgcactaaattgggagaccaacacttatacaattatctgttttttaaaacccatggttaaggaggccaaggcatcgtaaaagcaaaatggggaacaagcagttctaattggaacagttcaagaagttttaggtagagaagttatatgaggtatgtaaaaagccatggccctcagagaggctttgcactttatagaatgtgtgtgtgtgtgtgtgtgtaattataagtatatatacatgtataaacatggctgcaagaatagtatattcccacatactgtgtgttattcatatcaactgattggaactgagccttagggagaatccacattttctttcaaaatactctagagtagaaatgtttaaacaaataaaatagtattgatcccatttcagatgtataataatttttccttttttaatgtatcttcttttaaaaacagccttctcttattaaataagaaatacttggccaggtacagtggctcacgcctgtaatcccagcactttgggaggccgaggcggtcggatcatgaggtcaggagatcgagaccgtcgtcgccaacatggtgaaaccctgtctctactaaaatacaaaaaaattaacgagacatggtgacgcgtgcctgtaatcccagctacttgtgaggctgaggcaggagaatcgcttgaacccgggaggcggaggttgcagtgagccgagatcgcgccactgcactccagcctggagacagagcaagaccccgtctcacaaaaaaaaaaaaaaaaaaaaaaaagaaaagaaagaaagaaagaaaaagaaatacttgctcaccacagaaaacttaaaaaatccaggtaaataaaaatataaaaataaaaaccacccattattcttccagttagagatagtgactcaaaatttttgcatatatatcaagacattttttcatatatatatatatatatatatatatgcatatgtctatatttaacaaaagtggtatcagcctctatatgcaaatataagcttgttttttaaactacaaagtgtatctatccaagtgaccaaatatattcccacacataatttttagtgcttacatatatgttttctactgatggcttacttaactaagtatttattgctgaacattaaaattgttttccattttttgctgtgacaaacttccttacagctaagtctttaagggcatcatcattatttctggggaatcagttcctagaggatcaatcgctgagtcaaatattatgtacatttttaaggcttttgatccatatcaccactttcctctctaggaaggttgtgtcaatttataacgctatataaaagggcttgttttcttaatgttttccaaatttggtcagcccaagaaatctgcccatgaaataagaatttatgtagatggaacaaatagaataatatatatatatatatttttttccgtaagaaacctttcctaaaagccaggattttaagaaatcccacttacccacaattagcctttggtgcagtcaactgatttagacaagaactttttaagccaacttttcaatcaaagtctgccatgtttgtggaactgtggctatttaccattttacaatgacttaattgcaaattaatgtatatcttttttttcttgagaagatataataagctacctttttaaaatgacaatccattttattttcctggagaaaagaatccatttgctttaaccataatcagaggaaggttatttggtcaaacaaagtaaaaaccataaacaatagatagccatcattaccacagtaacattggtccagctaggaattcacttagctaaatgggtgacttcctactcacatacctcctcagtgcacaacaaacacaggagcaaacaaaagcctttacagaatccagaaccaccaggcaagaagatataataatcaagcaatcaagcaaaagtttaaaaatactgcctaaactgcaccaaaaaaaaaaaagaaaagaaaagaaaagaaaatgatactacaagagagaagttaatgaggcagaaagatattctcaaatataaaaccccctccaggacttttaagaaaggtatcagaggcatatggaaggctaagtccaggatggatttaactgaagaaaaggatatttagagattatcaacattttctaatgcaacagaaaaccaagccaacttagtctcctacttagtaagtgccagctctattcttcatctttttggagatccagaaaaatcaaaaagagaaaatatccaaatatagaagcttaatttaacaaaattggaaaaacctaaactatactgtgctctggtgacctagcaatcaaataatcacagtcatttggtcaatgtctatgattaactcaatgagacaggatgtttggctatagcaccaggtacaaaaaatatattttcatgaaggatcactccctcttatgtaatagatttgggtgagtgagtgagtgagtgagtgcatggactcacagcttttggctttctgaaataccctgcatcagtcttgttatgatgattccttagtgctgggatggatcatccaggcatttaaggtaacacgatggtaattctttgctcatttttcagggaaaaaaaaaagttatcacttccaaagtcggcatagtcacccgaagtaaaaaaaaaaaaaaaaaaaaagcctcagaggcaaaggaaaggggccgcaaccttggttaactgtgaaatgacgaatgagaaaactcctcctgctgaagatattcaggtatataaaggcacatgaaggaaaactcaaaacatcattgtcatatacacatcttctggattttttagcttgcaaaaaaaatgagcaccaaacctgatatgattcaaaagtgtttgtggcttgagatccttatgggtatattcattgctggcaccctatccctggactgtaacttactgaacgttcacctgagaagagtcacctggcaaaatctgagacatctgagtagtatgagcaattcatttcctgtagaatgtctacgagaaaacatagcttttgagttgccccaagagtttctgcaatacacccaacctatgaagagggacatcaagaaggccttctatgaaatgtccctacaggccttcaacatcttcagccaacacaccttcaaatattggaaagagagacacctcaaacaaatccaaataggacttgatcagcaagcagagtacctgaaccaatgcttggaggaagacaagaatgaaaatgaagacatgaaagaaatgaaagagaatgagatgaaaccctcagaagccagggtcccccagctgagcagcctggaactgaggagatatttccacaggatagacaatttcctgaaagaaaagaaatacagtgactgtgcctgggagattgtccgagtggaaatcagaagatgtttgtattacttttacaaatttacagctctattcaggaggaaataaggtatatttttggaattaaaattccttttccctccgaaatctctttctccttctcctcctccaacttctttttaaggattgttgtgctgtcctgtaagcctgtcctcagttggactggtagcctcggaacatcagggacactcacctctctaaggagaggtaatgccaaccatcctcagggtgaccaagagtctccttagaaagtctttaagacatttttaaaggaataagattccctctccgtcttcttctattctctcttgctcttttctgtggccattttgaaagagctttgctatatataccacctgtggacttcaccaagacaatggctagaggatagggagcagagaatgttgcaaaatggtaacatttcaatgacttaactgttttgctgccaaggttgcttatcctatgaaaattcagcacattaaaagagcttatacatgctccctagagtcaatactcttgcattttccccctcctgctcggggggaaaaaggttgacatttctggcccatttccttctcagcttggtttgtttgaattgatgcttgtggaatagtatttcattactttaagagtgaagatccatagtgaaattggatggatggttgaattagacgaccattaagctttcatttaacctttgagagtctgtgattctaatgtagcacactcttcattcctgatgtatattgtttgattcctacatctaaaggcatggaaaatgctgtggaaaagtatggtacagaatctgtcttttactgtttttcatgtgcctgaaataaaatgtccagagtcataatatggaacaattttacattagattttcctagttagaagactacattctgtgagttaatttaactagctattccaataatacataatactttaatatcttttatctttttaaaagttactttgcagccagactacctagattatttacttttctagcacggcccttcatctatattaattcaccacctagctgacatggattttctcttcctctcgcacctctatctaccccatttcagaatcatctaccttcaagcaagaattaacagagattgtggctacgcaaatgcaccaaaaaagggtgaaatatatctgaaatgtacctggttctgcccttggaagccatttcctgctcatgccactaacagcatgctgccaaactgttcagattcaagattattccaagcgcagggcccaaatgttatagccaaagaaagtcttatgataaaagtgaggcaaatttcagccaagaagttagaagagatgtttaaaagaacaagaacaaattgtggatcatggtatatgcaggctatcagcagaaggatcagacaataaaatgagttagtgcaaaccatttagtaaaaataactatcagcagagttgttccagattaaaaatagtactacaagcttgtaaaggagttaggacatgcaagctactgagcataaaatatatacttgctatttttcatgactttctctaataaagtctttgcctgttctctctaataactttactggaatgaggtcaattactttagtcatttatggttgcagtcctgccaagtgtttgctatcctggaggaaagagaatggctgagaaagccgagctgagctttcagttaatatacattttctgaatgtgtggcaggggtagaagtcagaacagtatgcttttttaaagatcacatctaatcaaaagaaaaaggataacatctccactggaaaaaaggcaagggcacaaactgacatcatcacaaaggaagaaatactacagacaatgtgaaaaatgtttaatctaacttgatttttaaatgcaaaataagatgacaagatactcccatcagtatgacagaaaagaaaaagaatgacaatataaaatgtgagtggagtgtaaggtataggagcctttgtgcattactgggaggaaagtaaactgggacatgttttctacagggaaatatggcaatcttcaatatcctaaagaacgcatcagcccctgtgacctaggtatcacgtcttccgaaatttattccaaggaaataggtttatgatatctcccccttttacattcattttcaccattcgatattttctattttttcctatagtgatttttttgggaagatttttaattctaaaagaaactgtacaagcttaacttccactataattaccctgttttccttagcggggtaggccaagacaagaaatgctcttttattttgttaatgatgcctttgggtacttcttgagtaactttggtcttttttgttgcttctgggttgctgctgctaaatttcaaaggaatccttccttggggatcattttcataatgaaatgtttgtaaagtgccttgcagtacttcaaagatgttgcttttttttcttttcctggttccaccgttgggaaggtaaagagatataatacccagaaatcactagagaaagtgctctatgtgtcgcattcctggcttagcagtctcacttcttttatgttaaatggaaactcaaaagttctgttgagttcgcaaagggaaaactctcagagctgtgcagagccaagcttctggtatccactgacaatgtctgagtgggtacatagatcataatgttcctacagaagcctctttcttcccctgggttgaggaggaatcaaaagtgtaattgagcttccttggaagagggactcattggggatcccacaggaaaagctggcaacagcaagtcaactgcaaggctatggggtagcataggttctaacaggtgcacagtctcagtcagcctcccctcagaggcaagacaactcgctgggcaccatctggggaccctgacttctcagagtagctactttgcttttgccccagttctttaatcaataatccacactaagaatgaacacaatgtgtaagcatctgacttgtgcagggaaacagggccgcctgcaacccaacaagcgcacccacaggggaactcgggaccatcctaagccacttgttctctgggacgtggaagcaggaactgtgctctagccgtatctgtgttgcgtcgtctgagtcctctttttctacaatgaagaaaggggacttgggatttaaacttggagcggtactcaaagccagaactccacgttcattccggagtgaaccaccacactactatttccaggcaacgtcataaggcttcctcgttatttgcatcttcgttctctttttggcgactagcctgccctcccgcccttggaaacttgtggaccccagaatctcagctttccgcctaccaaaggtgccccgatcccctcccactgccctagcagcggcccagccccaacgcctttggctagagattgaaatcctctggaaccaaccactggacgctctggattggggcggaacgcgcttccactgtctcgaaagcagcaccttctcggatttgagcctttgcggcgcgcctgggctgagatctgagaaatgcgccctgggccacaggcagcagcggaggcggggaaggaacaactttccctccgccctctaaccacaagggcggggtggggcggcctcgctggggtcgggctcctccactttcccagctgggatcccctgccggagctggcgtgggggccggggagggggaccagaggggcttccttctctccccaagccccgccagatgttggaaaggcaaacaataggggaaacgcggagaaacaaaaggccattcgccacgatctcagtcggctgcgtagagagatctctgtggggagggttaggggagagggtcaggaaagagcgcgaggggggggatcccgagagatttagagtctctggtacttgccaggcaccaggggtcggcgctttaccctcccagcaggggtctgaaggtgggaaggggcaatcaaagaaaacttgaagggttttcaccttcttccccagttcagggaaagggaggggctgggattccagatgtttgacagttgttggccccaaagttaagcgcgatttgtacggcctttacacgctccccacctccgtgaggcatcgtcagccccgggggcgacctggctgacggtgcggacttcccctacgctgccccaagccgagactcctccctcaggatcaggacgcccaagcgttgtcccccagcccaggcgcacttttgtaaaagtttgtcttcccgccacccacagcccaacacgcaccctgcaggcgtccgcggctggggatgggctcggagtcttgcaccccgaaagaaggacgatcttattgatttatatcttttcaaatcaaggacaaatcaagatcccggggtggaaagtgggcgacccttgttcctgccgggaagtgcacacgaggagccggccagaaacccaggcgccggcaggggtctgaagaggactccagccccggaagcccgtggccggcgggcagaagaccggtccgccgcctcccgcaccttcttgcacccgcgcccaggtgcgccccaaacctcgccgcccgcccgggcgagatcgggagcgagcagccaccgggctgcgccgcctcccctagcttggagcgggttcttactcaccgtggggttttacctccagcccagggcccggtcggctcccttcgccgggtcagctgcagccagcgcgaaagaaaatggtgagctcggggcaggtggggcgtcgcttgccaatccacgcaagggactctgccgccggtgcgcgaggtcccggcgagccaaccggcggacgggcgagcgcctggctccagctgcagccgccgtcgctccggagcagccccctcatgcacccagcgcgccgcgcagccggccggggctcgactgtctcgcggggacgccgagcggggacccctggcggccg

SEQ ID NO: 2411 - DNA, 742129 bp, Homo sapiens
gagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgcaggagggcgcggtctcacccccggtcccatgcgctggggttcgccgcgctcccgccgggcgtcgccacgcggtccaggggccaggagccggcggagtgagggattttcccgccccttgatccgatacctggtttagcaccctccgcgttcgtgctgaagttacacggggacttgcgggctctttcttcttaggatgatttccaggaatgttgcttaattacactgtgtgggaatgcccaggttctgaggagacagaagctgcctcaactctgttagtgaagagtgaggtggttctaaccttaagcaggttgaaaagtgatggttaaggagtctgggacctccaggaaggagatcaggctgtgtgcttcagcccctgcccttccagttccgctttggattttgttgaaatgttgcatgttcaggcggcgacagactgacagctgtcatcaaggagagaacagagtgaaccggctccattggcgcggtgccttgcagagggagtgtgtgtaatgggaagttagaaactagagtggggaaaaaaggccctttcagagcagagcaaatgctcctcttaatccctttggatcctggactggctctgtggtctattccatggtcacttgaggtcaaggccacagaccttttgagtcagacttttgtgtgtgagagattaatagacatctcccttgcgttatacttcagacagattctgagtgctctgccaagctttcttccaagcattgtattttttttcgagtcacaaatataaactagtatattttgacaagtgagaggaaaaagcttgcaatgaactttacttagtaatgtcatcccttgcaagacttattaactgagggataaaatcgtgctttttagtagttagtccttgtttacatgaaggctttagaatgttttcacttttctcttgcctcagtgttccagtctcccatgaaaacctcactttggatgtgcccttcattgttcacataatgcatgcataatttatgtattcgtaggtttgaaatcagtgactttttaagcctattggatagtgccttctgtcttgtgaaatacttgaatcaaacatattttatagtttcttgaaaaaaattttaaaaatttaaaacaatatgaatgttttctttcactaagaaaagaaggcaggagcttgatttgtattttggttttcagaaatggacatggcttataagttggaaaaactgactaaacattgagtcaacccttgattcaatgtaagattatagataggcatgctggattgcataatctataatgcctaatttctattttacatggaaataacaagtaaggtttttatgtagcagatttatcaatgcaattatgattttcttaacaggcattgtgatgataatgtttttgagatttcatccatcagccaagcatgccccttctttccactttcttagttgatacaaatgcaacttatttgtcaaagcttatcttaaaattccattttttaatgaagtcttccttggtgctccaggtaaaatcccttatattcctataatctcatagcacttcgctttttcctctgttataaaacatttgatacactcttaaataattttaagttatttacacatatttctcaccactagattgtaagcaacttgagggtagggaccatagtactagtgatctttacaaactctgcaagttcttagagctcatattaggagctgaaacatatttgctgaatttttgataatacataacatttgcaatccatacaggactttgacataaacatttcttttgacttttaaaactatcctgtgaggtagatactcatttcatttgtttgcaggtgaggaagttgatattcataaacagtttttccataatcaagagtttttggatggtagaaatattggggtgatggtaagcatttaacaactggattgtaaacaaaacaaatgtatatattacattataatagcatacaagataatcttctctatgtaaaagatgtgtagctctctgttgacaaatgatagcaatagtaaaatatgtaatagtctttagtgtgaattccatacagccattcaattttggcagaatctttttgctgagtttgaaaaactcttggttttataaatctgacatgaatgctggtgaatatttttgtatgctttaagaaaaaagaggaaagtgaaaatttgaagaaaatattcgaactttacttcatcaattacatgaaaagattcttggctgaattggataatagtttttaaatacttaaaaattatttcctcagtttctttcatagctattgacaatgtaatgtctatagacatgacacacttttaggtttaatatgcattatttaaaatatttctccattatttaaaaagcctagacaatcaacaaaacagtaagcaaccgctgatttgtggggtttgccaaattctttggtgtaaatactcccatcacgaccaatttcaagtatactttatatagcatttccgtcatatacataagataggcctaacctcaaaagcattggtaaagtaaaacacagcaaaataattaggaaggaataactgttaactattcagtaccttggtttttagtaggatttctttaaatttaagtttgcataatttaatttttaataatggctgtatttaacaactggctcacaaaattcctaaaaatctaacaaaaccaattctaactctgagcccgtataagcctgcttcagcatatcataggatagggatccctgtttcctagatctggtgcactttctactgaaaccaactgttttttttttgctcttttatgtttttttctgcttccaccaactgtcagacaatggagattatgaggcagtgaactagtgagggtgttgaaaggggatggcgttgggagaacacatctgctgaagacaatctacatgctcatgactaaggcttaactgggaggtcatcacatagatgatacattagttcctcctaaaagttaaagaaacaaataaaagcttttcgttatcttattcccattttgtctgaactactgtctggagtgggaaaataaaaactcaaattgggaaatttacttggagaaaacatatccttttcaagctagtatctgtggatgagtttcggtttgcaaaatctcagtcattttctacttttttcactccactgctctggctgtctttcatcattagtttttctccaggcttctgccctcaagatgtttgcctcatggttttcatttgtgatcctcctgattttcctagatgaaattaaagagaaagtgaaaagtatgaatacaggcccatcaaaaacgatgtgaaataattttttttaaagaagtgattcattactgtgtcactgattcatctagtcatccaagagcctttagtacattttttttgtaaggatactttcagttttgcttgttttataatactgtatatacttatcattagatatgtgtaatttatacataaaaagaagcacttgatcatgtgcttttagcacattcttttcaggtaccacatttaaataaaccttaattgcatggtttcaaagtctgacatgccacatctcatttcagagccattttctgagagtagcctcagtgaagcactgaactaattttggcaggcattgttcccacagagctttagacatcttcccaacctcacagaggtcggactctggcaagttcaatgtaactttggcatgttcaacacatcttcgtctcaggatgttattattacccatggacattcattgcacctttcatcacttcaaggtgaaattcttattactattagacctaggaataagggaaacaaaactcaaaactctcaccagacatatctgtggtaccagaaaccctacaagatttagagaaaataggcagcttctaactcatagatgtatattttttattgtagagaacatctgactgggtacagtggcttatgcctgtaatcctagcactttgggaagccaaggtaggaggattgcttgagtccaggagttccagatcagtctgggcaacatagcgaaacctcatctctacaaaaaattttagccaggtgtggtgagttgtgcctctagccccagctacttgggaagctgaggtgggaggattgcttgagcccaggagatcaagactgcagtgtactatgatgccaccactcactccaacatgggagacagagtgacactctctatctaaaaagaaagaaatacataagtaaataaataaataaatagagaacattctctcaaagaaaatcagcattttttctcacagtggaaacgaagtttagttaacttcctttccataccacattcaaaccatctgtgagcaaagcacctatgacactagaatgctgagataaatgtgttaagaggtgtctgtaggggggtggtgtagctgtggtaacatgtttttaactaagctctatgaaaggtgcagctcacctgtcgtagatattggacagcgaatgctgaaatatatttcttttactatgtatttatactgatactttggctttgacatggttttaatagttcttttcttctcctctgcactataattattaatcattttgtttccattctctttctttatttcaataccgtggttcatgctatgaaacttaaagttagtgaaacttaaaggttagtgaaattcaaattttgtctactaatgagacttgagttatactgtgactggtattgaaaccattctgcgttggcaaatactgaagggttacatcgtgagtaacaaaatgaattgttgtgcttgggtatcgtgtgtgtgtgtgtgtgtgtgtgtgtgtgtgtgtgtgtgtgtgtgtgtaggtctagcagatgtgtttggatacataagggttctgttttagatactttaagattctgagacttgaggccaagtagctgtcaggtacatgagtgtggaacctagagggcaagcctggattgcatatttagaattaagaatcatgaacaatattggtatttaaaaagccctggatgagatcaccttgggagagagagtacatagttgagactagaaccgaaaataggacttaatacaaggtgagtagagaacaaggagccagcaaaggatacagaagaagaggttggaaagaatcaacttactttaaaaatagggctgacatttcaagataaaagtaaaacaaaacacaaaaaacatagagctggaatcattggtaataaaaaggatatatgccaataaataattattatcaaattatatcttttgatttttttttctgagaggttaagagcaaaactatcattttaataaaaatacatgaattgtcatacttttgtattctgtcctaggaagccaggtctgtggaagcaaagtcaacataagcagtgatttccgtggcatgtaaatcatggtacagcaagagagtcattttatttaataagaattaattaacaaataattttattaaatgtttagtaaagtactaagcagtcatttaaattagcgttaacattaatacagtcaacatggattagttgtaataaatgacatagacccttcagttaacagagcattttgtttttatgaacaattgagtaaatagcagaacactctgacagcaaactgctgagaagagtgttatgggaagaatttcgtcctctaaaaagatacattgaagtcctaactccccatacctcagaatgtgattttatttggaaatgtggtttttatagaggttattaagctaaaatgaagccattaatttcttatgactgatggcattaaaaccaggaaatttgacacaaagacagaaaagcacagaggaaagacactgggaagacacagagagataaaaatcactcattaaaaataaaaataaaaatcagaatggaaaacacgcaattgggacgctttggggaaaagatgacagacaagatgttactgagctagagagacagtagaccttcccttttttccaaggtgccacatgaagactgaggattggagtgagccagggattgctggcaaacccatggaagccagggagaggcaaggagggagtcccctacaggcttcagagggagtaggcccagctgacacctggattttggatttctagcctccagaactatgagataagttgctcctcttgttttaagccacttggttgtgatacaaggaaaccctaggaacttaatacagaaagagagctagtctggagtatgttttaaggtagaacaaacctaggtttaattaaaaccacttaaatggtgaaagaaatgcttatgttcaatgtgcatgtggatttggacttacgggtggcagaaggttgagaccatgtcatggcaggaataattagagtcaaagggttaagttctcaggccagcagaggcaataggccaggcctgaggactcctggacagtgctgccctcatgggagtctttggatcagcagtatcagaatcacccgggggagcttctgaacaacagtggctcaggctcaccaggatctattggatagaaatattttggagaagggctcaagagtctcaaattattgaaagctccttgcatgattctgaggtagatcgaggtttgggaacgtttactcaaatgaagagttccctgggtcagaagaacttgaagaggaaagactgtggatacttcctaaggctattaggagcaaacccagtttctgaaggtcagttgagagccgagttagctgagttgccactctaaatgtccttagtttttaagattttaggacggatactgggtgtggtgcctcatgcctgtaatccagcactgtgggagactgaggggggaggatcacttgaggccaggagtttgggacctgcctgggcaacaaagtgagaccctgtctctataaaaaaaaaatttaaaaaaaaataaccaaacagtaagatgaatacttgtagtcctgcctccttggagattgaggtgggaggattgcttgaactcaggaggtgaaggctgcaatgagctatgatcatgccactgcattccagcgtgggtgacagaacaagaatctgtctctaaataaataaacaaacaaacaaataagtaaataaagttttagaagagttgcttctcttatggaaacttaatgtctatgatagcatggaatcatcctaacaggctcttcaagggctgtggtctgttatcagagggagtgtcgtgtttcccatcctgaataggtcagtcactgagactgcctgtcctctgcacatgtagcatctggtgtatctgcggtaggctgtctgctcttttaggtcgtaggctgggtcaggttcagagcctggtctggagagggagtccagatagaagccccaggaggaagtgggtgaagtgctccctcacagcccctcttgacattgcatctatttctttagtccaggacagtaaagatcactttgcttttataaaagtgcctcagggctcatactgcatggtttcaaggtttacttgaagtaaatggtttcaacattccttctagaggacacactaaaatggttttagaccatatttgtgaggctgacgaatgttcctgtttctctactttacaaaccaaatttcttatttttatttttaattggcaaataataatagtatatacttatgaggtaatttgatgttttgatatatgcataaaatgtggaataaaaaaacaagctaattaacacattcatcacctcacgtatcatttttttgtggcaagacatttgaaatttactcccttggcaattttgaaatatacaatacagtattattaactatagtcactatgctgtgtaatagatctcaaactagagtccttatgtttgtaaccctgatcagcattggtttgaatatgtccttctaataagtattcataagaaagttctgcaattctcatgacttaagcctccctgacatataactatgaaatttataacatccatcagaccttttctctcttaagcttcagttacttatttcaccttttgttttattaactaatacttcatattctttacgctgaaacctaatttgtttttaattctttaggttgaaacctcctttcccaaattccccctttagcttgcttgccctgccaagagatgtattgaattcattttctacaatgcctgattaatcttccttaagtggaaacttcatcctgtcactcctcttcaaaaaaaataatgtctctgtaagctgccatttaatgccttaccaaaatagaattatttcctacttctccaggtctgcatcctcagttccatagggacagatttctatttcatgaacaacacatattcatacccttgaacatatgtagttcaggcttcttgaagcaaatttcaaggttgtaaaactaagaaaatggagatgaacaaaattcactgaaatagaaagaagtatttatatatacctgtagttattattctttataaaataatgaattgcttttgtttttttcaaattatattctccattttaatcaaatcattttcattccggttacttacatatagatttttgttttgcctagtcctttattttccttaggagaataatctatatcataagattttgggaaataaattgttttctatccccagaacatcaatagtctttgcttttaaaacatgaactacttattttattttattttattttatttttttacctttctctcacaaattgtacctgtgttgtagcaatgtatgttttcagtctctaggattggaacagttatccagattatataagaaaggaatttcaaatattgtatgcttaaaaaatgagccaatagtacttaatattttggcattaggacaagatacacattaataaaaacattgcatggtttctttgcagaagttttgatgagtgatcaggaaaatgaacaaatctacatgtgcatacttgaactatttccttaggcatttgttttcatcaggtgaagatgaaatgcctcttgcttaaagaatcagattggctgggcatagtgtctcagacctgtaatccccaaactttgagaggctgaggtgggaggatcccttgagcccaggagttccagaccagccctggaaagacagggagaacccctctctccaaaaaaaggaaacaaaaataaaatatagatggttgtggtggtctgtgcctgtagtcccaactacttgagaggctgaggtgggaggaggttcagttgagcccaggagttcgaggctgcagtgagccttaatggtgccactgcactctggccttggggacagagtgagacactgtctaaaaaagaaaaaaagaaaaaaagaataaggtttacaagcacttaatacaaatcattcgttaaaaataaaaataaaaatcagaatggaaaacacaatattgggatgctttgggaaaaagatgactgacaagatgttactgagctagagagacatagaccttcccttttttccaaggccccagtatctggatgaaaccaaaatagtgtgaggaagaaaactggagcaaacagcagatcagcaacaatgaagaatccaggagacaagcagagtgtatttggcccaaggccttaatattagtttgtgcactctgtacactgcacaaaggtgttcatgtgttacacagaaattcagcacttgctctgcttgcatgaagggtatggtgggcatagtgctggagtattggtgccttttggctttacatgttgagagttggctgattaataacattgtgcagatgatatgcaatgggagaataaatatattacttatttttaaaataaagctgattaatgtggaagttaagatttatagtattttggacaacaatgagaagttaaaaagaaaaccacaaattattctttattgcttattttgattttcttataatactttctatgttgcacttttcagtaacattaattttgaaaaagaggagagattttccaattagtggatgctttgaggtcaattttaggaagactatttggcaaatacttgataaggttatatttggtatagcttctttcttaggtgcatcaaaaattcatgcttttaatccccattaaaactaattagtgttaatgtgtgtgaacatgcatctacagcagaatagaatattagactaaaatacttcatcaatgattagtattccaaatgccagttaaatggtagtacaagcaaatgacatatagcacaaactatctaatttacatttttaatgtgatatgttttgcaaagatattgaaataaaatggaaggtaggctatgaatgccctgtaatggaacattcttaccttaggtcttgatagagtataggagaatagatattttaagatgagcatagttataaacaaaaaaaatcagatgaaggcgttgacttaagttggagaatgtgaaacacttgaactggtaggttgctgttctgtttgacactggtaagagcatctgcagttcattgaactggaggagaaacatttatccattggtaaaaggagacgaaggtgaaggtgggtgggcggcaggagttggagtactgacaagggctctaattgcaagaattagatagcttattgttaagggaagcaagatcttggcagtgttaatgatattattcattttttagatttttttctttcattttttgcatagagtagcattctttagaatgctctgttcctttattaacaagaagtattgaaagaggattttagtgatcagtttctcgtaagagatatgagctcaacaggggtgacgataagtcataaatatatttctgaaagtttctattccagtaatgagagacacagtaataatttggtattgattaatatctagtataataagagtttgcatgtgggaagccataggctacagatgttgattggtttaattggttaattaaggtacaaacaggaatgctctacactcaagttatatttcctgtgctggtaactagctgtaaatgatcataattaagacaatgggatatataaattgttgttaatgataattctttaccaaatttgtatttaaaatataaattcttgatgaagttctttcaaattatagtttatgaaaagtaacatttcttagcttcaaaaggtcctcaagaaatcatctagagccattgttcgctccaaagcagttatgtgtgtgatgcttcaatactgaagcctcttctgttgaatcttaaatgtctctgagaatgtaaaacttgctttgatttccattctgtcttctattcatttgctttatatctggatggtgaacggccgatgcaggcagtcatgggctggagctgactcataccaactggggatagcttcctggtgggtttccaggaatcatgtgagccagttgttaaatacagctttattaaacattaactatataaacttataattaaattatattaaaaacaaaagtatacatatttaaaagtcaacactttctaatgattttattgcaatatactgttatctctgctctgggggttattttacatctacacggtacgtattttacatacagtttgtatggtggaaattctgtataacagaggattatctattgagtatctcttcccaattgtacatccagtgacatcatattggtagctaaaatttttttatgaagtgtttatatcatagaaatatcattcttaagctccccaggccagttgttaaattatttactagcatatcaccaggcaggggctttcttcataaggccagtttttttccttgtaccaaattggaactgattcataagcttttaatgtaactaattaatgcatgtatagaaagtatattttataacctaagtgttttatttattgctttgaatacgtctgtaaaattgtttaaacataatagagaagtttttattttcaaaaaattacaatattaaatcctttggttttaataatagcttttggatctccctaaagtgttcatgcacattgcataactgatttgttggtaactgatctgtggctaaatgattcagaactgataatgggttataggttgcacttctaggtgagtgactagaatctagaatctctcactatgagggaaagttatttctgcttaatgagtgttgattagttcccatgaggaaagctggacttactccaacacccagttcttccacctgttggcatcattggtcctaattagcttcttccacaaggatgtcaagtaatcaatggtgaaatgattgaaataccttttgacacccacatctggttcttccaggctgggataatctgcattttccattgtccccacatcaaaatactaaatattctatcttgaagaaggcttcaggaaggtgatttatttgtgagcacaccaaaacttatttagctcataaaatttcttttctaattattttaaaaagcaatcattgttacaatgcggaacaaaatcctcttgtgcttcaaattccattgtatcattcttattttcatgaggcagatattaatatattctctttcacagatgagaaaactgaaatgtgggaaaattaaggagtatgttgaaattatatgttatgctattgcttaaagcatgagaaatgtagaaatgcagataacaaaactgtgtgtgtgtgatcttagattagatcttagattttggtattgtgactgcattaaaaaaaagagtcactcttctgggcttaggtcaaacctgttgtgaagagtaattatttaagcaaacaatttctttacatgaaatgtgattttaaaaatgtaatccagatgacttgagtagtaagaagagacactaactctgggacacggctttttcttttgttttgtttttgccatttctgttggtagaaggtagctttccctcattattgacatctatttttggaatccctcaggaggaatcccaatttatcctgaaacaaaagaatgaaatgcaagctttctgcagaccaagtattttgcagtttttgcatgctctattttcttcagccgatgaaccacttctgacaaagctttctcactgtccggatataatctgctaataccactgggacctacactcacaagtgtcttctttctccgtaaaagtttaagccactaattctttttgatgtctgttgggaaactcttccttggccttgtagtattgtgattgccaaagatttgaatgtggcagccagaccactgacagagtgtcttgaatgcagggccaattagagggaagtattagatgaagccactgaaccattaggaggcttgcaaagatcccctaagagtcttttcatctacaagagagctgtggttggaaatacacagatggagttgtccttagggatgtgctcttcccgcacgtggttctgttgaagcatttcacaagtagaagacaacgttttgtaatatttcacagagcctatgtcatacagaggcacattggtcatctattattaatatgtttgtttggctcaaccaaaagtgtctttatacacactttttaactccttccctactaatgatacatttattagagggcagaggttttgattaaagatataagtaatatgatttttatagctcagtttttctttcaacacaacacaaagtgaagcatattaattgtcttagtatattttccttattgatgaaaaactggtttggtatttgcaaaactctgcatgaattctaattccaaattcttgatttttgtcccactatatttaggaaataatattgttttcacatttagaggaccacatcaaggctaaaaagataattgtatttaaacatattttaagatgtttaaactttgtatttttatatttttagttatcataaaatttaatttgtttccaaaatcctggttaattttcattctaccaaatagaggtttaaaatgctcttaggagaatggtagtcaaaggtcttataaaaacagaaatgtacttctttagtcaatatgtagtttgctttatattaaatgaagaggtaatctggaatgtacatttggattaagtgtcagctgtaatgcctatgtgcttttcatggcccaaaaggaaaggaaaaacagtggagaactgttatcctacaggcatcagaattacgctgatgggccatcagctgctcggcagccaagcatttctccaaggtgctccagtgagtactgcaggctgacctcatggatgtatgggtgaagaatcacaactagatgacaggactagtattctaggaccaatatttaatgtgacgtaacttaatccaagttggtatatgattatgatagtagccaaaaatcagatgacattagaaataggtggcccagattgaaatagatgtgactgaaaacatagtgtagtaaaccactgcaaatttaatactcttcatctgtagacctaaggaataaaatcgttgaatatttttggacttattttccattcaagtatagaggaaatggtgttttgggcaggaccatattacgtatttatatatgaacttcgatacatgcaatgatgccaatttacaagaaagtcctgagtacgaagatctaaacagtaataaactacagacaaaagatgaatcagaagtgtaatattttcttaagctgtaaatattggaatgcctaaatataggctaattgctaaatatatgtagcaatccactgaacattggtcagatatatttaaacaaaggaatatgatagtttcatatttctaatagtgaagtattttcgaaactatacagtcaaacttgaagaggaagctaatttggaaatagttcagaaggaaaaatgagggaattcatattgcttagcctaatggtggattatttgcctcctaaggagctgtctcagaatgttgaaaggaatatattccccgctggccacctgcttctgccctgttttctccattcctggtgttattgtcccactttgcatgttctgacccaccccaattcctgagccaatattgacagagtcaagacagtgtgtatattatcttcagctcttcagttggtatccattaaaacattaattaaatcaaatacttaaacttctcttttttagaagtgggaagaataacaaggtaacgatattgtaagtggctgactagagaaacttgggcaccttccttattactccttccccacttggttctcaagcttccttagtggttcccaagtcttggtacctgctaactggtgattctaccctatgttattggtctgggcctatggatataataagatgcagttggagtttacttggcactgaagttagctacagctactgcttatgctctatgtcaagctcttactactgagaaagatacaagcacagaggcttctattccaatttttatgatacagcatcctcaccctgcaggaccctagctgcagcttgatctgtccagctgtccattgtgatggtaaaattacaacatcacggtgcatgtgccactgctcctgggactgtagcctggctgcgtcacaccatgaatctttctcactagccacatgttttgtgaatgtgacactctcatgaagactcttggaggtcacctagagcaatgttttatgatctgaccttttccacccatatggctgagaaaggagccatgtgatatttccaacatggccactttcttgacctaagaaaagagtgatatcagaagcatacagctcatggcagcacatcatggatgaaacaggtacataaaaggtgccattacagaaaaggagtttggcattaattttaagtcagtgtataagtgatgtattcttaactgtctactgcccaaatcattatttaaaactgctacctcgggcttgagagtacacgtatccttctttctactacttctttgcttttctcttcatcgtaaagccatgaaagtgactattctataattaatctcttctacaaactgccaggcataatcaaattctgtaaacacttttgtctaaacaagatgtgttgtgatgcttatggaagaatatttgggaaattatttctttgaagatctgtagaatagagtagattggggaaacttttgtccaaaaaggtagatacagccattattggaggcaaagaaataaactgagcagctttcagtaaacatctatagacacgtaattggtacatggcattggcaaaacaaacatttttaatatttatacattttaacataaatttaaaataatgtaactttatttaaatatgaaagtaaatctattttgtattttatttgtgtcttcaagcctattcccttctttattcacacttaaatttttaacactctgaagtagaatcgctggaaagctctgcatggtgaaaactttttggctgtatttttatagtacacatttttatacaaagatgtggcattaacactgtaaccgggtgacttcagatttttggacacaaggaaatttaaaacaattcaatacttttaacctttgtgtgtggtgtctttccagtttagtttgagatttttaagtatctgaaagttagtggcctcaatatggtgtgattcctgcatttatcacataaggccacagtgccaatgaacagtaccctggggacctatttttcagaattttccatggcccacaaaactaatttaaattgagttctcctttgctttaaagggaatttggtctcttcaccctccttctctccttactgtgtccctctgttcactcttctctgtcctatgtttgggtcctagaaagtctcctcttggactcctcagaggggagaaataaggggacaccaagcaaggagccctggacccctctcctggccttactccataggaaatgaaggctcagaggattttgagtgaaataaataagattctatgttttataaaacactggagtctaaataagacttaatttgggaaaggagttatactactgaaaacaatcataaaaccactactttagagtgtgacatgaaatagttcgagatttatgtaaccttggtaggaattaccatattaaaataaattaagatttctctcttcatatgcatgccttcttattaaatgatgtcaaaccccttttagtaatatacacatatgaaagaaaaacgattattttaaatagatattatcaaaatttcagacatattcgagggaaacgtagcatgagttagttttacatactatgtaatttaaaggaaatcttgagaaattgtaacatatgtctcatgtaatagttgtagttggctccatctgagtcaggaggcgggactcgactctggaggcggggctcagacaccagacaaggttgaggactagctaaaacagggaagagggagaagcgcctcttcctaagacaagctcaccagtgtgccaggtcagtttactgctgccatggcaacacccggaagttactgcccctttctgtggcagtgacccgacaactcaaaggttaccaccccttttctagaaatgtctgcacaatccaccctttaatttgtatataattaaaagcaggtataaatatggctgcagaactgcctttgagctgctcctctgggcacactgcctatggggtaaccctgctctgcaaggagcaggatctctgctgctgctgtgcattgccacttcagtaaatgttgctaagaccactggcttgcccttgaattattccctgggtgaacccaaaacctgccaggctaagccccagttatggggcgcatctgccctgcatcacatccatcattgctgtagtacagtaattacatttcaaacatgtttgcatgatatcatattactttcaaaaacataataattctggtttctgagttataacaaaatataaatagaattctcttattgtgttccacagtgacaattttggagcatgtagatatgattcagaattgaagcaatagaacagatcattcaatttgattttcctgcaaaacatttttccttatacagaaaacttgccagtttgtttcctttttaatagattactaagtcagtgaaacatggtaaaatttcagtgtttttaggttaaatatctgcagtttcttatgtttcccttaattatttgttatgattctcttggcagataacatgtgacattaatacatttaatattataaggtggttgtcttctctacactattatttcatgctaatgttccacattgctttactttttagttaaccttttactattcatatatatttttcttctatttgaaggatagaaagggtcctgccttacttgcttttgtattccccacagtgcttgtgtcctgatatacacctaacagttgttcaataggtattcactgacttcttggtaaatgagttattatgtttcctacaccatcaggatgattttggtcataggaagcagagaattcaggaaaaaattgcttaaacttgtgctactgaaaatatgtcccatagattgttggtcagaatacaaactgtttatttctgatctgcaagtagccaagtaattaagagcatgcatttagaaacatttatagcaactttaatgtatcatgacatccagtggctggtcatttattctaggaatttgtttttattgtattttacaatagtttttgtcctcaactgattgaaaattttaaaaaatctaatttcttaactacagggtgtttaagaagcacagatttagacaatgggtatttattaataacaaatctcatatagtaagaaatcaaggaagaaatagttgctgggttgggattcaataatgttcaacagtggtagggctcccagttgatgtttctcaggttcccttggtcttccagcttagctacaatatgccgtcagcagttacaagcctcatgcttccacatgaaaatactcaactggagaaggaagaggacagatgcagaacagcctcttctctctcacagctctctttttgtctggagagaaagactgtccatatctagaagactgttcatacttctttccatatctaattgaccagaattgggtccctgtcttcccctggatcaatccctgtaaaatggtcatggcttagtccagtgtgatctatcctctggggggacacctagctgcatgaccagagtcagggatctctcagcaagaaggactggagaatggctgttctgcaaatttctccaaagacctaaaattatcagaaattgacatcaccactgacaatatttcaataagtgggaaggtataaaaatagctcaagttttatgcaatacctgttatgttaggtattgtgcataactcttcatattttgtaaagcttccctccacacagtcagtattatccctcttttatagatagggaaaaggagacatcagttaagtgtttcacccaaggtcacattgctggccgataaacagagctgagattccaacctaacaccatgaatgtctatacccaggttctctctactgctacaaaggctatttttgtatggttctggttgggtagcttgtatatgcataatactacaaatctgggaatgcctgaccagggatactagcttgagaaaagggctctctaaataggcaacataaactctcttaacatttctaagtacagttattgcatttctggtacgtgggactttttcctttagctcactaaaatgtgaccctctctgttgctgtctgaaatacatcttcctgtacaacatctgtccctgtcattgctgttccagatgtcacaggaccctgctgttgtcttgagtttggatgtaatgtgcgggagatgtattctttgtaattctggaatctagaagaacattgctcaataaaacccctgtgcatggtggataagtattgcttgcaactttactaatactttatggccatgctatatatcaatagcactgtgccttagctaggctttcctgggctatgaaaaaacatttttaaccccagagagtgccaaacaaccaactttcaaacacttctttgcaacacagctctttgataagctgaaaattgcccagtttatggaattctttcttgatcttatacttcctcatattccaattccctagaaaattgcttttgagaaagagtagacagtatatctctggagtcgcccattattttttttactccactgctgagctaggtatacaatcctgattatctttgactatgttcctttctgtgggtgctagtctattctagctaatacagggtgcatagcaaattttaaaaggctatgaaaataagcttggggacacttgtcttcagtgttcaaatacgtagattttattatcacatttctgaaaatgtattacttattaaactatgtggatccaccttaaggtatgtttttcctttcacagtcctatattgttaatgatactcaattgtgagttactttaggtcagcaactttgacttgtgtggcatttgataatgctcattaatgttgctgacattgtctttggatggaaaacctcagcatgcatataatgcataatttcacgagattcactgttttataggaagccataaaaacaaaacatggggtataataagtctatctattctctaaaaatttccatgtactttcctttaagtataaaaaagtaatttatgttaaagtacgaacaatgaaaacaatttacttaatttatctttctttagctaatgcggaggtccttattattattattattattttatttttccattgttttgtaactcagatcacagagttttgtttgtttgttctgagagagggtctcactctgtcagcactggagtgcagtggtatgatcacagctcactgcagcctcgaactcctgggctcaagtgatcctcccacctcagtctcctgagtagctggtatcacagtcatgtgtgaccacaaccaacaaagttttaaaattttcttgtagagatagggtcttgccatgttgcccaggctggtcatgaactacttggctcaagcagtcatccttccttggcctctcaaagtgctgggattacagtcatgagcccctgggcccagcccatattataggctttgtactttcagctcatatgcaatgtgtttttttaattaaattttaaactataaatttaaaaattatagttgtatatatttatgaagaaaaaagttataatttatgagaactatgtggaataattaaatcgaattaatgcatatatcacctcaaatatttattttttgtgatgaaaacatttttactctcagcaattttgaaatgtataatacattattatttactgtgttcaccacgttgtgcaatatttcacaaagaaaaaaaaccttatcctgcctttctaattggctttatactctttgacaatcatctcctcattactcctgccaatctccaacccatggtagccagcatttcactctgtgattctttgagttcaattattgtagattccacatgtaagtgcgagcatgtggcatttgcgtttctgtgcctagctcatttcacttagcataatgccttccagtgaaaaacaagagcagtattgaagggttggctcaattgaagtttagcatgtcttgtgaaataatttttcttcctgttcatttgaaaacttatgaaaatattaaaaattggtactaaaaacataactgatatttttaaatgtcactcataagaacatacatattcatcacatttctcagtataaaccaagaaacataagaaaaaacatccaaaatacattttaacgtctttacaggctgctttagttttagttagaaataatatagagagtcaaagactcaaattataaatctaagtggctctgcattctgccaagattggaatgcagcatggatgaaatttactgtgacccaaactttcaacaaaatagttcatgacaacaagataggaccacaaatgaggttttttattccaataaattctttgacttatctgttcttactgttgtctttaagcacaagatttgtaggtggccgccaaattgggaattttagaaaagaaagttttaaatggaactgactccagctgggaattgagaactgtttggtgttttgtctgggaggaagtatcaaggtgttcctaagagctgaggtatatctgaaatggtagtatcaggaagtttgcagggttagtatgaaatgaaatgaaaatttcaattgtactgtatcccaaccaataatataatgtcttccttacataatgagcataatgctggagtttcacatagtaaagagtaccaacaataaatagactcatgttagctgttttaattttttcaggatatgaagggtctcattggtgtgatagcactagagaggatttgggattttttccccgttttaaaaaaattatgttttagagatcatctactacagtcacttttgtcagtgaagagagaattgatttcagctctagtgattcttcaaagaacattctagaatgctgaaatattttggttcctcagctttattatccacaacacttagggaaactccacagagatgtgttatgagctggaagccacttgcctccatgttgcggtgaggggcaggattgctgggtggaagcgttgtgctatttacgtagctcagctgaacagttcacagagatgtggctattatagaggcagtaacgttaacctacaaaaaatatctgccctccaaccagtctcagataaaacagtagaatcatagattctaccaggaaaactgctcaattgtttgttgtataaatggattgttgtacaaatgaataaatgagggaataagtggatagaattttggaatgaaaatgttgttcctagattcaagttattcaataattttcctttggaattcatacagcagatcatcccaacttgattcttaacccagggcagcattgtacttttctactcgcctaggacatttaagcctgtgtggagacaagtaggttatcatagtgttgggagtatgggggatatgagtgttgtggttacttagttcccaaagcactgaaatgctaacgccagtgatgaacaggaagtcctgtgcaacgaggaattcttgcctacgatagtaaataatatccccaatgagaagcagtgagtctctctctgggttctccgacaggaaggctaaagacaaaagtcctcatttctcaagtaattggcgactttgttggacatttaacattcaaaaaagacttcttatactttgccaaaacattgcaaattgtactcagtaccagctttgtccttcaaagaatagagacctgccagcttctactaaggttattcttacaactcatttacccatgttgcccatctggttactttcttgagggcgctatgcaggttgtctctgtccctgtcaaggtgaggcattcagaactccatccaatcctctaactatggcctgccaagtggtataaataacacgtacagccctagcggtcatagctactattttttccttagttctgcaaactaagatggcattaatttttttaaaatttttgttagcttattatcaactaaaacttcagatcttcacataaactgttgtcagtctgagaatccatcattctgagctagggattagcaagctttcttggttaagggccagatagcaaatactttagataccaaaggtcattcagtctccatcacaactactcaattccacagctgtagcatgtagccatggacaatacagaaatcactggggtggttgtgtttcaattaaactttatttgtagaaacagatagtaggatatattcggctcttgggccatagtttgctgatctttgttctatacttaaagaaatattagattaaaatagaaatttagtgctttttaattatgtctgttcatattattttgttgatttcagccaatcattccaaccagctgagaacctcttgaattctaattgtgggagttctgttatttaatttaattaaaaaaattatgctgcttttcaactttgtatcacctaacacatgacttctttgcttttatgtattaatagttcttctccattccaaaacaaaaacaatacctgaatagaaaaaagccttaaaaaggccctataccatatactagtttttcagtttaagatggtcagtgatacaattgataaacatgttttggttactgtaatgataaaactacaccattcttctatcatgcagcagacagttctttctgttctttataggaagtactggcccttgtctgcatttccttcccgaaatcaagatgcatgtctatgacaagttcttgttgtgccacagtgttaataccaacaaatctaatgttggtcaaatataacaggcttttaggaaatcatctgtttacttatgtatttttgcagtcagcttagaagagatgtgaattttatcagcccagccctgtaccctcttatgagatgtttacccaaatggggctttcattcctttgtagcatgaatatgtaaacaccttactacggttctgaaatcatagttatgagtccattagcaccctaatgggaaggaaggagttaactgtgatatgtaaatccccccttcctttcctgaagacaatctgggccaggtgctgacctccaccaggcctcctgtaaacattccaagatttagtaacagaaagatgacctaggaggttcaaatataagaatgtttttatttgggtattctttttctatctcgattacttactataactaaacctggaattcgtgggtttatttgatgcctatggctggagagtggaagttagtccaatgagctctttatctgcatgagaaataagtaagaagccttaaacttattattatttgttttctgagatagcttgcaccacacacataatgagcattcatctgttattctggaaccaaactgcatcccatttgaaaaaaagcaattttttggagactgtgagagacagttgaagtcttttttgttactgcctgtgtttctgttgttactatatgcttcactaatctccattgaagttgggtgtagtctatgatctgtgattcctgtgaaccagctgtgataatgtaactctttgggattctgcactatgataaaatgcagatggtcctcagacttgaatgcatctaaggcgttggggaaggtctctggttgctttacattttcttgattttttttctatttaaacaaagcagtttaataaatttctaatacattttcttgctccagactgcctggaaattcatttttttttaaatttagttattattatactttaagttttagggtacatgtgcacaatgtgcaggtttgttacatatgtatacatgtgccatgctggtgtgctgcatccattaactcgtcatttagcattaggtttatctcctaatgctatccctcccccgaccccccaccccacaacagtccccagagtgtgatgttccccttcctgtgtccatgtgttctcattgttcaattcccacctatgagtgagaacatgcagtgtttggttttttgtccttgcgatagtttgctgagaatgatggtttccagtttcatccatgtccctacaaaggacatgaactcatcattttttatggctgcatagtattccatggtatatatgtgccacattttcttaatccagtctatcattgttggacatttgggttggttccaaatctttgctattgtgaatagtgccgcaataaacatacgtgtgcatgtgtttttatagcagcatgatttatagtcctttgggtatatacccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgcattctaactggtgtgagatggtatctcattgtggttttgatttgcatttctctgatggccagtgatgatgagcatttcttgatttcttaagttaaatttccttttaaggtatttgttatttgatgttccattttgattagaaaaagtggagaaagaaattttgtaattctgaattttctctgttatttcccccacattatgagcctattaagctgattgcttccatattgatagacttacttcaaattcttttttgtaatcataaaaattcttccttttctagtttaaagaccagcttttatgaccaactaagaataaatttaagtgtgtgaaacatagctaaatgtttttaggttaaaggagtagaagaatcctatgaaatttacatttaaaagcttatttagtttagtgcaatgaatcacatttggcatattacaatttttaaatgctaatattatatttatcagcaaattatttgcatattaccataatgtgagtctttaaattattttgatattgaaatggagataatatattgaatagtatcgactcttctaaatttgatgcttaccgtttattttcttcttggaatatcccatgcatttttagatgcttaagaaataaacttattgaggctgtaacagctatgtagaaactcagggtatctttttttggtttaataatacccaaaaggttggaaatgtacaaaaaatattaaatctgagagcatggtaagttactgtatcggtctactatgtcagttctgattttgacttttttcttttttcttttatttttttgagacagagtctccctctgtcacccaggctggagtgcagtggtgcgatctcagctcactgcaacctccgcctcctgggctcacgcgattctcttgcctcagcctccttagtagctggaattacaggcctgtgtcaccacacccagctaatttttatatttttagtagagatgggatttcaccatattggctaggcttgtatcgaactcattacctcaagtgatccgcctgccttggcctcccaaattgctgggattacaggagtgagccactgcgcccagcctgattttgacttttttcattagcaatggaggagaagtatttcagagtagtgacaaggcactccattgcttgatggcagcactggatataagaaaagaaatctagatatagatcaattattgtgctgctgatgatctcaagctctgtactaatgagcagttacgaaaatgagagatgatgttctattaagtacacacatgcttcatgtggattttgaatgtacctacgtatttggttttgtctgttaaaatcactttaaaattaggttggcaaatttcccaatttattaatttatctatctttttcaagatagaaaaaagtaatgttcaagagagtgttatgaaaggttaaacgtaaaggccaggaatttgtaattactagcagtcatgctttgctaaattaatgagaagataattgtcaatacattttttggtaggaatagttttgtttaagtcaaacattgcattaaaataattatttggactctttttagaatacaactgtgatttctctgcttcattttcagtggtgaataaaatgcatgttttaatttttttctatgtttaatttttcctagaactctatacttttaccatataagattctaaacttttgaactttgaattctgtaagtttttggcattataattttaattaattgttaataatagttaaattttattgatcactgggtttcaaatttaataatgatgcatatggaaagcgtttttcagaaaatgtttaaaaactatttttgaaagtccagggtaaatactattgaaattaataaaaatttgttattacagaacaagcatatttcagctacatttttaatgaatctgtcaaaagagttattgggtaggaaattatataagtaggatacattttttcctagggtatttttttgtaatctgcatgattactgttttgtaattgaacagaaagcagtttgtatttttaagcatctggcttttttcattattaaacttagacctaggtagaattgtggggatgtgtaggggtgtaggtggacgggatttattgatagctactaatgactgtctcccactcctaatccctctgaattgcccggtgttgcaaaccctccttctgtgggctttggtggtgactgacgtctcatgcgtaagaaaggtgagtcattatcctttatacaacatagcttgtgtggtatgaaaatttatcatcttctctgaaactgtctaatatgtagtcacctctaaagtaattcacttaagctaagttatttttctagtaagaaatcccaaaaagggggatttaaaatttctcttgtgaaaaaggttaaggtaagttcagatggattttggatatggccttgaataaagttcactttacttacttttaaaatccacttttaattttctgaggacttctgcttctggcaaggatgaagtcggtggttttgaatatactcttttgagggtaatagctatatcactggataaaatagatgaggcagtagttttcaggcactgcacaacaggtaatgtgggactatgatcttgagataaaggagactttacctttaaggtgcttttccagtgtagagcaagaacctggagcccaaccggagtacagcagtcttgctaacatgacaagacaggtattggagatcagcacggagacaggcagagcaagtaagagaaagctacatagagaggaacaaggcgttgatgtggttctgtctcaagacattgcctatgacctgggccgccacacatgcctggattgagactctgtggagcctctcctagaaaagctgctgcaggatggagagctgaagagactcaggtcatgtagactgaagaggcctccctgagaagtcctaaggcagttagtaccataagggttatgccaaggagtaagtcatcataccctagaataagggtcacatgatagaactaaggaatgaagcaaagtagacccactgtacaaagcataaaaccatgcctgacaggacccagagatcctactgctggttttttttttttatactttaagttttagggtacatgtgcacaacgtgcaggtttgttacatatgtatacatgtgccatgttggtgtgctgcacccattaactcgtcatttacattaggtatatctcctaatgctatccctccccactcccccgaccccatgacaggccccggtgtgtgatgttccccttcctgtgtccaagtgttctcattgttcagttcacacctatgagtgagaacatgtggtgtttggttttttatccctgtgatagtttgctaagaatgatagtttccagcttcatccatgtccctataaaggacatgaactcatccttttttatgggtgcgtagtattccatggtgtatatgtgccacattttcttaatccagtctatcattgatggacatttaggttggttccaagtcttttctattgtgaatagtgctgcaataaacacacgtatgcatgtgtctttatagcagcatgatttataatcctttgggtatatgcccagtaattggatggctgggtcaaatggtatttctagttctagatccttaaggaatcaccacactgtcttccaccatggatgaactagtttacagtcccaccaacagtgtaaaagctttcctattctccacatcctccccatcacctgttgttttctgactttttaatgattgccattctaactggtgtgagattgtgtctcatagtggttttgatttgcatttctcttatgaccagtgatgatgagcattttttcacgtgtctgttggctgcataaatgtcttcttttgagaagtgtctgttcatatccttcacccacttttgatagggttattttttcttataaatttgtttgcgttctttgtagattctggatattagccctttttcaggtgagtagattgcaaaaattttctcccattctgtaggttgcctgttcactctgatggtagtttcttttgctgtgcagaagctctttagtttaaatagattccattcgtcaattttggatttttgtttccattgcttttggtgttttagacatgaagttcttgcccatgcgtatgtcctgaatggtattgcctaggctttcttctagggtttttatggttttgggtctaacatttaagtctttaatccatcttgaattaattgttgtataagatgtaaggaagggatccagtttcagctttctacatatggctagccagttttcccagcaccatttattaaatagggaatcctttccccatttcttgtttttctcaggtttgtcaaagatcagatggctgtagataagtggtattatttctgagagctctgttctgttccattggtctatatctctgttttggtaccagtaccatgctgttttggttactgtagccttgtagtatagtttgaagtcaggtagcatgatgcctccagctttgtccttttggcttaggattgtcttggcaatgtgggctcttttttggttccatatgaactttaaagtagttttttccaattttgtgaagaaagtcattggtagcttgatggggatggcattgaatctataaattaccttgggcagtatggccattttcacgatatttgttcttcctatccatgagcatggaatgttcttccatttgtttgtgtcctcttttatttcgtggagcagtggtttgtagttccccttgaagaggtccttcacgtcccttgtaggttggattcctaggtattttattctctttgaagcaattgtgaatgggagttaactcacgatttggctctctgtttgtctgttattggtgtataagaatgcttgtgatttttgcacgttgattttgtatcctgagactttgctgaagttgcttatcagcttaaggagattttgggctgagatgatggagttttctaaatatactatcatgtcatctgcaaacagggacaatttgacttcctcttttcctaattgcatatcctttattcctttctcctgcctgattgccctggccagatcgtccaacattatattgaataggagtggtgagagacggcatccctatcttgtgccagttttcaaagggaatgcttccagtttttgcccattcagtatgatattggctgtgggtttctcataaatagctcttattattttgagatacgtcccagcgatacctgatttattggtagtttttagcatgaagggctattgaattttgtcaaaggccttttctgcatctattgagataatcatgtgattcttgtctttggttctgtttatatgctggattacatttattgatttgcatacgttgaaccacccttgcatcccagggataaagccaacttgatcgtggtggataagctttttgatgtgctgctggattcagtttgccagtattttgttgaggatttttgcatcgatgttcatcagggatattggtctaaaattctcttttttgttgtgcctctgccaggctttggtatcaggatgatgctggcctcataaaatgagttagggaggattccctctttttctattgattggaatagtttcaaaaggaatggtaccagctcctccttgtacctctggtagaattcagctgtgaatccatctggtcctggactttttttggttggtagtctattaattgttgcctcaatttgagaacctgttattggtctattcagggattcaacttcttcctggtttagtcttgggagggtgtatgtgcccaggaattcatcaatttcttctagattttctagtgtatttgcatacaggtgtttatagtattctctgatggtttttgtagttctgtgggattgatggtaatatccccctctatcattttttattgcatctatttgattcttctctcttttcttctttattagtcttgctagcagtctatcaattttgttgatcttttcaaaaaaccagctcctggattcatggattttttgaaggttttttttgtgtctctatctccttcaattctgctctgatcttagttatttcttgacttctgctaacttttgaatgtgtttgctcttgcttctctagttcttttagttgtgatgttagggtgtcaattttagatctttcctgctttctcttgtgggcatttagtgctataaatttccctctacacactgctttaaatgtttcccaagattctggtatgttgtgtctttgttctcattggtttcaaagaacatctttatttctagcttcatttcgtcatgtacccagtagtcattcaggagcaggttgttcagtttccatgtagttgagtggttttgagtgggtttcttaatcctgagttctagtttatggtggttgtttagatatattaagcatgtatttatatgcatatatgtaaacttatgcatgtttgtcatccagatatattatagtgtgagttcacattttcttttatgttgagcaaatattcaaattgaatacaggaagcccaagcattttatgagttctgatgacaaatatcacaggaaggacaaaaacaatttttttttaaaaaagcatgcttgttcctctcacatctcatgtcctgtcacttcacctaaattctctgtcctccctcaagttatcttttttttttttaattttctccatgttttattttcctcctggatctctctcgagacatctgtaaccaacagaaattagatgcacaaatcctttttgttccggggggctttgcaaacagtttactctcaagccgaccccagaccctgggtttctcatgtggtcttcagactacccatattacaatagaaaacccactcgggaaattggagctgacaagtcttgagatggttatcccactaatttccatccctgcaccatttactaaaagtgatacaggtgggtggaaatcaggtgaggcctgcttctcagaagtaaccaaagatgcctgcacacctctgtgtgtccctcggcctattcttcccgggatggcgaatgtagtcaggtgtggggcctgggcttgtagggatacccaaaaattttctagggaagtaacctcactttattagagcttcttgtctcaattcagagtatagatttttgaatgcgtttgctgacagattgacctggactgtgttttccccttattcagggagcgatcgatctttatcaaaaggatttgttgactgatgggctttcacagttctaatgtgctgtttgatacttttaaaagacatatgcccctttgtataatgaaattacctgataaaacagggaatgaagctcaggttttctgaagcatcttagctcttgactgctttggtgactgccagggaattttgtttgtatttgcctgtgatggaaaccttacaaccttagtgaaattgtttttgaatattcaagtttctagaccatatactgtccttctaggcctaagggcctgaactaaaccaagattgtgtttccctcaggtaagtacttccagacactctatcctctctgtctttacaaccctcttctcctcattactgtactatgtaacactagatgcgcattatagtccacataaaaagccatttctgtagcatcttgtcatcggttcatggttgtgctttgaagccgtgttgagttctgaactcagagcctaacagcaatggctcaagtgcaccacaccgtattatttacccagatggggttaattgttaaataaaagaatgggccctttcagtttacttttttgcagtctctctaacactgattatggaagacagggaagactatgataaatatcaaactttctaatcagaaacgagtccagttgtatttgaaatcttgaacttaatccagaattagaaaatgtccttaagttatcttttgctttcttgagaccatctgctcttacgtggctatttttttttttgagtttctaaatatatttgtgtcaatcctgatgacaaacccatttttcagttccttgaagtggttgtggagacaggactgttccatagaacaaaacattactcaagggtcatggataacaagcaaattacacaaatagaaaatttaaattggatccctggtttggtccacagatcaaagttctttcacaggatcccttactagaaaattttccagtacctggattaacccaaagttactattttaaatcatatatatgtcattatattttctaactaattattgaagttatataccatattttttctaactgattattgaagtaggattttaaattatcttatatatttcatctttgatttaacagtgtttcaggagattcccttaatttaaaaaataatataattttataagctgcaaataatgacaacttttcttccatcttctttgcacagtatgtcacagcatttctgtttgtcctataatggtcccaaaagccattttaggtgatacatggacaaatattttattttagaaattttgtatcttgtatactttcaaaaaatttacagtaaaaaacatatgaaaggttttttatttctttgggaatactttaaaaattaatgtattgatttaaagagaaatcatacaacaggcatcacaaaagcattaaaaattattaaagtgacgtgtaaaaattcttgtgcatggaaaaactgaaatgccttcctacctgctcattatgaactcttcttccacttttcctttttgagacctgtgaccacatagccgagaatgtcacgtgcatatattctccctaggaaaatgggagtcccagaaggggtatcagagaaaagtttgccagggtgaggtgggccaacaggcattggtgctgtctggctcacaaaagtatgtttgtgaaactctggggagctgtcaattttctggttgttgtaacctctgtgactgggacttacggggagacagtggtggctttctgtcttcttccactttttttggtgctgtccttgctgtgctggttaaaagggtagactgtacccaggcgcggtggcttacgtctgtaatcccagtactttgggaggtcgagggcagatcacctgaggtcgggagtttgagatcagcctgactaacatggagaaaccccatctctacgaaaaatacaaaattaggcgggcatggtggcacatgcctgtaatcccagctacttgggaggctgaggcaggagaattgcttgaaccttggaggtaggtggaggttgcactgagccaagattgcgccatttcacttcagcctgggcaacaacagcaaaactctgtctcaaataaataaataaataaataaaataaatgtagactgtgtggtgcttagtttcaggaagtaaagctcattcaagatccagcagtaacaaagcactctgggtagaaaaacaggaagaaagggataaaacatgaatgtggtgtaattgagatgcaaaaaaaaactctgaaaactggagaatctcacctatgtaattacctaaatgcaggtgaacaagaattcctgggtaactgtggttcagatttcctcaagggcatctgagttcagtggttcagacatgcacctgtgagtaagttggtggggaaaattgaccttttagtttttagattctctttagtgaaaaatagcaaagcagttttttaaagtgtgggttcaggaatatactagaatgactctgtaatttcatctcaaatatattgctatttttagaaactaaaggggtactatcctggggctcttcaatactcatcataaaaccaatcctttaatcttactcctggtgtatcccacgcttcgcagatgctaatgtcccccaaatctaggtttcactagaaaagaaaacgtcactgtaaaatggagaatgtatgtgttctaaactattgatctgaagttgccagctataaaatcttggcaaaataatgcttctattgggttgtatatttcatgatgatgaaaagttgagagaatacataaatgtatactgtgcttacctacagaaatagcgtctgctttatggggggaaattctagctttgttgtatctcattatcaggagctgtggtattcttttaaggagtccttggaatgagagctgaagaggctgaaccaaaagtcagcttgtggctagagcagattatgtggaggaactctttagagagtcgctgaaccctgccctgggtttcattgtgtgttctgatctctcctcttctgctcccagtggggctctgagttagacttcaggttttcctcagagtgactctcagagctctctgtgtgagcatagctggtattggtccccctgccatctgatgtcaccacgtgaatttaggatgaagcctgatgcccaagggccttcaaactccactctgtccaatccctttttctttgaacttggcagattagggtgacccagtcatacaaaaatatctgaaccagacagcttgaaagcaatggcagtttttcttcacttaagattttacctaatttatcaactcaattttctatacttgaatattggtggaaaaaaggaaatgctgaattggatgcagctattctagacaattgaatctgtgtattatgcatgtgggcgtatttatgtatgatgcaccttcttccatttactgtacttgcagtggcttacatatttttatgtgcaagatatttatttatatctgcatccaaatgtctagccaagtactacgtatattataggcactcagtaaatgtttgttcaatcaaaatgactttaaaatagagtaaagatgatttaaaggaaggaagtgatcattccagatatctgaatacaacagaatattatcattgggccattcatttgattgtaagcttcttaaattcaggacactaacccctttgtaataaattgtgcaggatttagtttctcacaaaacagtgcataacaaccttaccttgaaagaaaaggaatacaaaatttatcttagcaggctatacataaagacgtggtgaaatatagtggttagcatccttgactcttttgtatttatataaaagaagatacagtatttttttttaaatgaacagtgctcatatgcccactctcaaagctagaaggaacaatactgaaccgtaatttaatgaaggaattctctgtggaagagagataatgttgtctaggaatcctctgtttatagtgtaatttaatacaataggacttgaataatttaaatgaataggtttctattaaaccatcactttcaaatagtattcttggccagtttccagaaccaatcagtttgtgattccttaacaattgtctgtaccatggcaagtcactgctactgattaaataaagaatctgtactttcaagtactgacatgaagaggcaaaggtgaccttcagtggtgggtggcttgggagcctgacttgtgttctttgcctggacagaagccagttcatttcagcataagattgagctgcaggggagtctttggggagcaaatggaaatgtgttaatggcatttgtctgtactttgaatagagatacttggaagtatgtttgtcttattgttttccttcattttagaaaatttattttggactatttctacactctttgcagacctttgaggaaaacatcttatatgaagggctgaaagggtagcttcagtgtatttcaactggggcatggaaatccctggattattccctcatactactatctgcatggctcagacaatgggacattcctttatatccatgccctgatttttgcagaccaaatcagggcatggatataaaggaatgcccctcttgtctgagacatgcagattacagtagccctttggctcatacgaggttgtgataatgtaagtgttagattagtctctggttctgatttttagaaggtttaagttctagtgtccagcaaaaatgcatcagtgaagctgacaggtgcgtaaggcaaacatcataatgatattagactcagcgtgatttcatgcattaatatggagtttgggttacgctgacctcacatcctggtttgaatcctgattcattgagcagcaatgtgaactagggcaacacaacaatctctgagcttcagttttgtagttttgtagtctattaaaatggaaataaatattaacacatatctttgaggcttatttatatagtcatagtatataggtttctatttctcagctttttggggggaattcttgaattcttgcatataaaataagatctctttatttaacaacagaaaatcctgattgttggattctattagcacctctgttcggttagaaaacctactaaatgtaaaataaaatttctcttaggagtttttttatgttcatttatcaagatttgatctattaaaattttagcctattaaaatattctggtgtctcatagcctacagaaaaagtgcacattcttaacatggtccttccacattctgattctaacctggctattctttgtgtccttctggtcatctccctctactgtgatcttcctgcagactcctttgggaagcacaggcatctcatgccctctggtcgtgctctaatcacattgacttgcttagcctccgcttaacctgtatgttctagcacttcctagtttccacgtgttttctcacctaatgacctctttctcttctttctaccttcacctgacaatagcctatgaaggcttttattctcagtttatatagctcctcttcaataaaacctcctaaccctccgagtaaaataagcctctccatttgccttgtgcttctacagtgcctttggtagaatcacattctgcctttgggtctatatacatgtcctgcgtgttggactgtgggcttcgtgagaacagtgttttcatcagcgtttaccttacataggctagttcctttctttttatcttttttaattatactttaagttctagggtacaggtgtacaacatgcatgtttgttacaaatgtatacatgtgccatgttggtgtcctgcacccgttaactcattatttacattaggtatatctcctaatgctatccctcctccctccacctacctgacgacaggccctggtgtgtgatgttccccaccctgtgtccaaatgttctcattgttctattcccacctatgagtgagaacacgtggtgtttggttttctgtccttgtgatagtttgctgagaatgatgatttccagcttcatccatgtccccataaaggacataaactcatccttttttatggctgcatagtattccatggtgtgtatgtgccacattttcttaatccagtctatcattgatggacatttgggatggttccaagtctttgctattgtgaatagtgccgcaataaacatacgtgtgcatgtgtctttatagcagcatgatttataatcctttgggtatatgcccagtaataggatggctgggtcaaatggtatttctagttctagatccttgaggaattgccacactaacttccacaatggttgaactagtttacagtcccaccaacagtgtaaaagctttcctatttctccacatcctccccagcatctgttgttacctgactttttaatgatcaccattctaactggtgtgagatggtatcacattgtggttttgatttgcacttctctgatggccagtgatgatgagcatttttttatgtatctgttggctgcgtaaatgtcttcttttgagaagtgtctgttcatatcctttgcccactttttgatggggttgtttgattttttcttgtaaatttgtttaagttctttgtagattctggatattagccctttctcagatgagtagatggcaaaaattttctcccattctgtaggttgcctgttcactctgatggtagtttcttttgctgtgcagaagctctttagtttaagtagatcccatttgtcaattttggcttttgttgcctttgcttttggtgttttagtcatgaagtccttgcccatgcctatgtcctgaatggtattgcctaggttttcttctagggtttttctggttttaggtctaacatttaagtctttaatccatcttgaattaattgttgtataagatataaggaagggatccagtttcagctttctacatatggctagccagttttcccagcaccatttattaaatagggaatcctttacccatttcttgtttttgtcaggtttgtcaaagatcaaatgggtgcagatgtgtggtattatttctgggggctctattctattctattggtctatatctctgttttggtactggtaccatgctgttttggttactgtaggcttgtagtatagtttgaagtcaggtagggtgatgcctccagctttgttcttttggcttaggattgtcttggcaatgtgggctatttttggtttcatatgaactttaaagtagttttttccagttccatgaagaaagtcattggtagcttgatggggatggcattgaatctataaattaccttgggcagtatggccattttcacaatattgattcttcctatccttgagcatggaatgttcttccatttgtttgtgtcttcttttatttcgttgagcagtggtttatagttccccttgaagaggtccttcacatcccttgtaagttggattcctaggtattttattctctttgaagtgattgtgaatgggagttcactcatgatttggctctctgtttgtctgttattggtgtataggaatgcttgtgatttttgcacattgattttgtatcctgagactttgctgaagttgcttatcagcttaaggagattttgggctgagacgatggggttttctaaatatacaatcatgtcatctgcaagcagggacaatttgacttcctcttttcctaattgcatatcctttatttctttctcttgcctgatttccctggccagaacttccaacattatgttgaattggagtggtgagagagggcatccctgtcttgtgccagttttcaaagggaatgcttccagtttttgcccattcagtatgatattggctgtgggtttgtcataaatagctcctattattttgagatacgtcccagcgatacctgatttattggtagtttttagcatgaagggctattgaattttgtcaaaggccttttctgcatctattgagataatcatgtttttgtctttggttctgtttatatgctggattacgtttattgatttgcatatgttgaaccagccttgcatcccagggatgagaccaacttgctcatggtggataagctttttgatgtgctgctggattcagtttgccagtattttattaaggatttttgcatcaatgttcatcagggatattggtctaaaattctctttttttgtgtgtctctgtcaggctttggtatcaggatgatattggcctcgtaaaatgaattagggatgattctgctttttctattgattggaataatttcagaaagaatggtaccagctcctctttgtacctctggtagaattcagctgtgaatccatctggtcctggactttttttggttggtaggctattcattattgcctcaatttcagaacctggtatgggtctattcagggattccacttcttcctggtttagtcttcggagggtgtatgtgcccaggaatttatcaacttcttctagattttctagtttatttgaatagaggtgtttgtagtattctgtgatggtagtttgtatttctgtgggatcagtggtgatatcccccttatcattttttattgcatctatttgattcttctctcttttcttctttattagtcttgctagcagtccatcaattttgttgatcttttcaaaaaaccagctcctggattcatggatttttcgaagggtttttgtgtctctatctccttcaattctgctctgatcttagttatttcttgacttctgctagcttttgaatgtgtttgctcttgcttctctagttctttcaattgtgatgttagggtgtcaattttacatctttcctgctttctcatgtgggcatttagtgctataaatttccctctatagactgctttgaatgtgtcccagagtttctggtatgttgtgtctttgttttcattggtttcaaagaacatctttatttctggcttcattttgttatgcacccagtagtcatgcaggagcaggttgttcagtttccatgtagtttagatgttttgagtgaatttcttaagtctgagttctagttgattgcactgtggtctgagagacagtttgttataatttctgttcttttacatttgctgaggagtgctttacttcgaactatgtggtcaattttggaataagtgcagtgtggtgctgagaagaatgtatattctgttgatttggggtggagagttctgtagatgtctattaggtctgcatggtgcagagctgagttcaattcctggatatcttttttacattctgtctcgttgatctgtctaatgttgaccgtgggatgtgaaagtctcccattattattgtgtgggagtctgtgtctctttgtaggtctccaaggacctgctttatgaatctgggtgctcctgtattgggtgcatatatatttaggatagttatctcttcttgttgaattgatccctttaccattatgtaattgccttctttgtctcttttgatctttgttggtttaaagtctgttttatcagagactaggattacaacccctgctttttttttgttttccatttgcttggtagatcttcctccatccctttattttgagcctacatgtatctctgcatgtgagatgggtctcctgaatgcagcacactgatgggtcttgactctatccaatttgccagtctgtgtcttttaattggagcattaagcccatttacatttaagtttaatattgttatgtgtgaatttgatcctgtcattatgatgttagctggttattttgcttgttagttgatgtggtttcttcctagcctcgatggtctttacaattttgcatgtttttgcagtggctggtaccagttgttcctttccatgtttattgcttccttgaggagctcttgtaaggcaggcctgatggtgacaaaatctctcagcttttgtttgtctgtaaaggattttatttctccttcacttatgaagcttagtttggctggatatgaaattctgggttgaaaattcttttctttaagaatgttgaatattggcccctaatctcttctggcttgtagagtttctgctgagagatccaccgttagtctgatgggcttccctttgtgggtaactcaacctttctctctggctgctcttaacaattttttccttcatttcaactttggtgaatctgacaattatgtgtcttggagttgctcttcttgaatatctttgtggtgttctctgtatttcctgaatttgaatgttggcctgcctcactaggttggggaagttgtggataatatcctgaagagtgttttccaacttggttccattctccccatcactttcaggcacagcaatcagacgtagatttggtcttttcacatagtcccatatttcttggaggctttgtttgtttctttttactctttttttttaaacttgtcttctcacttcatttcattcatttgatcttcggtcattgataccctttcttccacttgatcaaattggctactgaagcttgtgcatgcatcgtgtagttctgatgccatggttttcagctccatcaggtcatttaaggacttctctacactgtttattctagttagctattcgtctaatcttttttcaaggtttttagcttcttttcgatgggttcgaatatcctcctttttctcggagaagtttgttattaccaattgtctgaagccttcttctctcaacttatcagtcattctccgtccagctttgttccgttgctggcgaggagctgcgttcctttggaggagaagaggcgctctgatttttagaattctcagcttttctgctatggtttctctctgtctttgctgttttatctacctttggtctttgatgatggtgacatacagatggggttttggagtggatgccctttctgtttgttagttttccttctaacagtcaggaccgtcagctgcaggtctgttggagtttgctggaggtccattccagaccctgtttgcctgggtatcaccagcggaggctgcagaacagcaaatattgcagaatggcaaatgttgctgtctgatccttcttctggatgcttcatctcagagtgacacccagctgtatgaggtgtcagtcagcccgtattgggaggtgtctcccagttaggctactcgggggtcagggacccatttcaggaggcagtctgtctgttctcagatctcaaactccgtgcttggagaagcactactctcttcaaagctgtcagacagggaagtttaagtctgcagaagtttctgctgccttttgttcagctatgccctgcccccagaggtggagtctacagaggcaggcaggcctccttgagctgcagtgggctccacccagttcgagcttccaggctactttgtttacttactcaagcctcagcaatggcagacacccctcccccagcctcactgcagccttgcagttccatctcagactgctgtgctagtagtgagcgaggctctgtgagggtgggacccttcgagtcaggcacgggatgcaatctcctggcatgccgtttgctaaggccattggaaaagagcagtattagggtgggagtgttctgattttccaggtaccgtctgtcacggcttctctttggtaggaaggaattctctgaccccttgtgcttcctgggtgaagcgttgctctgcccttctccatgggctgcacccactgtctgacaagccccagtgagatgaacccagtacctcagttggaaatgcagaaatcacccgtcttctgcatcacttacgctgggagctgcagactggagctgttcctattcagccatcttcagcctagttcctttctgagagtaggcactcgaaaatatgtattgacatgaattgatttgaaaaactttgatggagagtatctttccctcatattcagtattttttatttgactacacaaaaaggattataataaataaaattataaacattgaacaccctgctccatagagatttgctaacagatgtgttctttttactcttaaatactcctattttttgagacagagccttactctatcacccagataggtgtgcagtgacaagatcatggttcactttcagactcaacctcccaatttcagctattttcccaccttagcctggggaccacaagcacgtgtcaccatgctggtaaatttttgtattttaatttttttggtagagatggggtctccctatgtttcccaggctggtctccaactggtgggctctagctattctcccacctcagcctcccaaagtactgggaatataagtgtgagtcactgcacctggcctcctgtcgaaattgagtcaaagtaattacctacatagttcaaattctagagaggactcaacacttctatcctttccagaaacatacaaacacacatctctcaggtccttttgatattctggggcatgttccagtgtttgtgtcatgttgttggggtaaccttttacatggatacttggatcattttttcttctgtaaatctatgtggcacctgtccctgagactttggagggtataacaaatcaaggagtactttgaaaggaggcacaaccttaaatagaatagtttctttctttggatttgttttggtgtacctcatctcattaccaatgtgtcagccattgcataccaaatcaacatgtggatataagggaatgtgcccttgtctgagacaagcagattatagtagacctctggttcataggaggttgtggcagtataagtgttagattagtttctgactctaatttttgtaaggtttcagctctagtgtccagcaaaaatgcctcagtgaagctgataggtgtgtcaggcaaacatcctaatgatatcagactcagcgtgatttcatgcaacaacttggagtttgggttactctgacctcacatcatggtttgaatcctgattcactgagcagcagtgtgaactagagcaaaataacaattgttgagcttcagttttgtagtctataaaaatggaaataaatattaatgtatttttgaggcttatttatatatatgtagtatagcggtttctatttcacagcttttttgggggaattctccaattcttgcatataaaataagatcactttatctaacaaaaagagaaaatcctgtttgttggattctattagctcccctcttcgggtagaaaatctgctaaacataaaataaaatttctcataagtgttttttaatgttcatttaatgtcaacatttaattaattaattatatttgtttgtttgtgtattcaagaatgtttattgagaagctactttagaccagcaaattctatgtgctggggatatagcaatgaacaagacagacaaatctgtgccttcataaaattacatttctaataacctcacaccttagtgtaaatgttctgctttagccaagaccaacttgcacatcagcaaataaagctagtccatatttttgtttgacctgtaagactgtattgagttatttcaaaaatcactgctggctttgactacagcaaatgcccccttagtatttgctgtgatctgtgtaattccacgtggacctaaaactctttttgtgtttggagaaaagaagagttgttaaggagacacaaggatacaacaggactccttcatagggaaattaaagaagtggatcctggaatgtttgctgctatttcctgctgggatatagttaaaggtgagggagagtgaaaagtaggaggaggctgaataactttctgaggcagtcatgagaaccagactgctggaaaaagcttgactaactaaattgaatgtgttagtgtagactctctgtaatcatttcatcatgacctaccactaatttgtgtgggagttgaatgtgataggaacctaagatgctatgccaataaacagttataagaaattctgtgtgccttatgtttgaaaatctttgaacacaccatctcctattcaaggctggttgtagcatattaactgtaacttttttttaaaaaaagagattttacagttattgtaattaacatcttcaacagggcaagaaaagacaggatgtatttcaagtgattgaaaccttaaattttcacagtttagtgtgagagacactatgttagacttgtaaatttagcagatctgtattgagaggaaaaaaataaatatgcttctttggtgtccatctacatggcaacagctccaggattcctatctctagcccagactttctgctgtgttgcagatccatgcagccagtttcttcttcattggcctccctaatgtaagaattccaatatgtagcccttggtctcctcctccctctcatgcttctcagtggctttgcctatttttctacttctggtgcttgtctccacccatttgctcattatagagacccaagaccctcacattctttctcattgttctttcctgagccatgaccaagtcgttcaggttctatctccaaatagctctgcaatgcatttgcttttctctgccaccatgttttgctagatcactgcaatcacctgctaaatagactgcttggtcttcttttattcttcacgtgtcagccataaggatctttcactggatcccttccttacaccttatacaaaaattaattcaagatggattaaagacttaaatgttagacttaaaaccataaaaaccctagaagaaaacctaggcattaccattcaggacataggcatgggcaagcacttcatgtctaaaacaccaaaagcaacggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatattcagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccattttgcccagccatcccattactgggtatatacccaaaggattataaatcatgctgctataaagacacatgcacatgtatgtttattgtggctctattcacaatagcaaagacttggaaccaacccaaatgtccaacaatgatagactgggttaagaaaatgtggcacatatataccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagatcacatggacacaggaaggggaacatcacactctggagactgttgtggggtggggggaggggaagggatagcattaggagatatatctaatgctaaatgacgagttaatgggtgcagcacaccagcatcgcacatgtatacatatgtaacaaatctgcacgttgtgcatatgtaccctaaaacttaaagtatcataataataaaataaaataaaggatctttcaaagaatacctctgatctgattctggcatgccccagtatcaaacctaccaactacttcccaccataattaagacggtaggccccagtatcaaccctaccaactacttcccaccacagttaagatggtaagccccagtccacagcagagactcttctgatctccacttccctccctggcatgagctccctttgtccactgcactgcactgcagccacactggcctttttttctgtgctcctaagtcccatgttctttctatcaggagctttcccaagtgctactcctcctcggtaagccatgtgtgtatcacctttcttgtcttctcttcgggatcagtgtaaggtaagggcactttttaaaaagaatctttccaacctaaatctgttcctccagctgtagatcttgtttttgtttttgtggcatttatcataaccagtagctagctattaacatatatattaataaatgtataccataatacatatattaataattatattaagtatgaatcaataatattaatatattaatatattaatagccatacattaatgatatataattatgagtgtgctttatgtcttccccaatacaatgcaagatccctatcacttgacagtttcctatcacaatacagcaggtacttcacaaatatttgctgcatgaataaatgaataaatgaaaagtatagagatgagaagataatgttttccctgtatgtctaagacatagctttttcatgttaaataagcccatgcttctcatgaagctaaccaacttaaagttagtacaatggtgtgtacttgtaaacagaaaaaaaaatttgttgttctatcattttttgcacttttataaaaatttatttaaaattatggctaaacactgtgcaaagaagagaaaaacctcctctcccccacaccaatttattatcctccctgtttcagtggagcagtggatttgatgtgataggtgctcagatgaaagcactgtcatgggtctgtttcacagtaatggaagccacagtggcttggttgagtggcccatgtcagaaatttggccttgatgatgggattggaaatgcttattccctgttcacacaggttggactcccagggcgaccaagaggtctataattttgctatagtgagtgctcctcagattgagaactcaggattgaaagcacaatggttaactcaaatgaattttattttatcattacctttttttcatatgaagtcaagatttatattcaaactagttttagagaaatacacatttgattgtaaatttaggacttgatgttgactcaaaaaaaaaggaacacctctctgtgtattaccccaaatttttctgcttcctatttttatggcaatgttcatatatagtctactaaaataggtatttattttagttatgcttagaaacaagagacagttttaacaatatgtgaacacggaaaggctttatttttattgcttttgtcaccttttcttagagaaaaagaacacagtattttgttaccagtttcctggcatagttttagtttaaaaattgtcttttaaaaattgatatgctgctttaaattgtagtgtggatcagtacattttaaataagaaatttggagagtagtagtgttgtatttaaaatcatgatcagaacaagaatcatttctgtttcattggtaaaacttgaatggctaaaggattttcacgtcctatagtagctgtaacagatcgatactgttaactggatgcaacatttgtatccttagctgcatacaggtttgtatgcatggtggtggtggttggtgtgcatgtgagtcagtgggggtgggggaacccttctaagaggtggccacgggataacaatgaaaaaatatgttcacaatcatctgaaacctaatcatattttttaattcaacgtaggaaagaacctctttggaacagatgtataaacaatattaaattaaacgagaacaaacaaatgagattataatcctgctgttatttcacttaactttatctgggtaacatagttaaataaaggtagatctagatcataatgagtttatctactcaaagggaaaaacagagacttctgtgaaaagtttaatttctaaatataaaaagtaaaaatcacagtcaattttaaccttttattatcacctttaaaatatatttttctagcaattaaaaagtaaatcaaagtctatgagataaaaatattccagaaaggataagtaaaaagagctttaaaagtatcttatttggccaaaataattccttattataattgttagaatttatcttacatttttgcatttgatgtcaagtgaaaaaatggaaaaacacaattttcatataaattattgaaaaggtttggagaagtcacagtcagctgcagcaaacattttcttttgtggagcagtgagtgtgtgatggtgttgggagcacactgagtgttttagctccattgagttatttacatgttcttaaatgtgtgcctttcttttctccttagccagacttcgaatctcctttaatgtagaaatcattacgaagtacaaattagagtgaaaaacacagtgcagtataagaaaacaaaatatacattataatagtagtaaacttggcagaaattgtatagaactatgaacagaagactatcaaatcttctaaagaataaagactttagtacatgaagagactgggcattgctctattttggatatattaaatgtagtaaaagtatgaaatttttgcagtcgaattcataagtttaataaaattaaatcaaattcaaagaggaaattctataaattcaaagaaatcattctaatattcacttgaagtaaatagtgtatttttaatcataaaattaaaatgttatttaagggaaacatctctatagctagtgttaaaagaaaaactttagaaaaattaaattgtccggagtttaatggagcaaagaagtatttgccaattggacagctcccaaaacagaataggttcagagaggctctagcactgcctcatgattgaagatttatgaacagaagaaggaaaattacctatagaaaatagaagtaagatacaaaacaactggactggttacttggcatttgtctcatttgaacactgtttgaacagttgggcacctttgatttgcccaaacccagtgattggcttaagagtagattacagcccattacatattcagttaggttacaattcactatgtatgaaaaagccttctgaacttaaaatatgtaaggaggcagctttagactaaacttaacagtagcattgatatattaaaaagtgaattaattttcaaaacagcattttgtaggtttggtacacaaataggtttctgaaatagaaccggtttcccagaaatattttcttgtataattctaaatataattagtttttccaatttgaatcagcctttcaaagaagcatatacaaaagcaataaatataaatgtggctgttaccatgctgctaaccaaagttgaaaaaagccagggatgccaatagaaacttaaacgttctatttcatcttggaaagccttactccatgctatcttaccacctgtaccatttggaaattcttggttttcagcagtggccaccacagacttttgtaaaagtagcctgaatgccatcctttaattaatctgagtgttctcacttccctaattattctacaaggcttccaagatgaataaaaacatgttcatctagaactgcctccttacatgttcagaattctcaaatgaagctattcatggagtcatgacttggcagtgttttctatttcaggttcggcaaatgggtaaaccagggcattgatgtgggttacctactcattaggaagaaagcacttctgtatacttgctcattaatctcttctacttccctaaaccacatgaagaaaagacattctttcttcttacctcagctgggttctgcacttcttttgcagtccttttcatcaaagagagctctacaggtcaatatttcaaagactagacatcgtttctagctcctatagagaaaaatagttaaagtttgttacacagaggctcttttccccttagctcctttttgaaagatgtatcaataacaaagacagtataaacattaatttaaaatatcattttagctaagcttatactttgttatagtcacagactatcccaagtaagtgaccatgagggatgtcaatatacttgttggattcttgatagtgaattctggcttttcttgtagtgccaggacataaaaggtgctcaatgggtattcactgcatatagataaaatcctatcccctacattgtttcagaggtgaaaaagctgtcaactgatctccagagaaaatgttacagtttattttcttcttagtaaacaaaagcataagggaaaaatagaatgatagggcttgatctgatcataacaaagtattatttagggcatctttgttaaaagattcacagtttgttttctcatgctccctgggatttctttacagtggtaacattatatagaggtttgggctgttaactcctcccagattgtgtcacctaggaacacagtggcctcttgacacattcacattgcaaatcacttgagctgcatacctgagttctacttcaggggatgagtatataaggagaagaaagtttagttccctggtcattgttgtggaccctgggataacgaaaaacaaggtataacattcaaatcagtagggacaattgggaaaatgtgttctccagcagttgatttactgtgttttttaaaaacagttgtgctctttggtcactgaattggtgacaattaaaatgaaatgtgtgaagttgttgaatgagccctagataaacctaatagccctggaatgatccacagtgtgagcaaatttccgcattctaatttcctaaggttgtcacatggctcttgaaaaacagccaatgactgaggatccaatttctagtccactcatttcctatctcatgtatttttaatgagatctttcctccaaaaagttgtttgctaacagtgaactgcacttcagagtacccaaatgaagtttatctgaaccagatgatgctaattgcagaatagattgtcttaaaatgaagactccttttggaattgtaggttaatgtgttgaagggattcacacacataatttagaagctatgagatcttatacttgcgttttcaaagaatagcattgacagacaatccactttattgctttatctatcaagttggatatgatacattttagttaggaatcagcttattttttgagagttttaatttgaaaaaaatcagataacttcaaattccaagtcaaattgttgagactgtataatttaaaaaagtgcatattgaaaacattgcctgatgcataaaagaaatacagcctctaaaactcataacctaatgtcttatttttaatactgtaagattatttattaatgcctagaataaaaatagccatttaaattgtgaaggttgttacagtactataagtttaatttctaaggaagtatttgataatcttctacatctaatttcgattttgaaaaacacgattagtactgtcttttaaagaagttgccaggagcagggaagtaggaaaatggaacaagacttcaccttcttcctaatcagccacaagatcaggggtaaacctgtttttatatttaaattgaaataagatgggcatagccatcagcatatatacatcctaagggatggtgtaaaaatgagttgctgagaagatatgtgtctgtctaaatccatagagatttggccctacctttaagcagattgtccattaggaagagaactggtgcaagaaattttcagtgctctctcagccccaatctaagcacagagaaatgtagtatagcttggtgcaagtgttttttgtggagctccaattcacttcttttcttatatggtccactaagaagctgttttctaatgcataatttaatcttctgagctgagttgcttaggacaaagtagtcatctacatgcttttttcccccttttagtatgatttgtaatcagcacaaaattattatagacattttgggggaataatgtgatatttcgatacatgaaacaatgtgtaaatggtcaaatcagggtatttagcacatctatcacctcaaacatcatttctttgtatgtgtatttgttaaaatgtaaagatgcaaacataatgaagcaagaatggggaattgaaacccagcaggtatgaagtactagtctcaacctgttactaactgaccttgtcttctggggtaattacttaaacactcctgacctgatattctatgatttattcatttcccaccactgactggcttagaaaatcttctgatggaactcaaccagagtgacagcatcctgctgtggttgtgtccttggtgtgtggacattcggcatgacgttcataggccagcagaagctactccatactcaagtggaaaatcgattttgggtggaccaaatcttgcattataaaggctcagttgtactggaaagtgtcagagatgtgaggcaaaaatgtaatgaaatctcagttctaggcctcattagctatgtcaccttggtcagtcagatactgatgtgtaaaatgagaataattatcagctggtttaaagatcagaaggagggtctgtaaaggaaatagtacattgcctggcacagaatagcttatctttaagcaatggttattcttagtgtgtggttacatttatcatagcatgttactcaccattcattatataatacttaaaggattttttttttgtctttcaaccctcagtagcacatccatttttattgcttctttagttgttgatagctattttgaacacagatatttctatgaaatacgactttaaagctccaatggttacagatcattcaacagaaattgggttttaaagggagaaatcgaatttgagttagggaattccataacgcatacagatataattttgacaaggtcctactgcaaaaattgcaacaaccttaacaactcatcttgatgctgaacaatatggtcatggtcattagttaggatacacatggaccaatatacttcattaagtgcctgctgactattgcttctcattgacaaatgcattcctagagaatcgctatttttaaaactcaagtttcaactttctttctagaaattatggaagctatctatactctttccctgcatgtcctttaaaatatctgtccaggatgctgtaaatctctttggaggtctaaacaccatggtgtctccaggccctccctctgggccacaagcactaaagtgtgatgatggatggaaaagaatggaaggttggtctcgctggccttctccttctgggtcctaagcatttatggtcattgggtatgtgtcgttaggactgaggatcttgactcattctcattcgtcaaaatagcaaatgaggagtttgacctgtgagtcctgagcttactgcttctgctgttcaatgttccaagccatttccccatgtgctaggggggtcctgttggccagcattcagtggggcacaaaagaacatagtgtaggcatggggatgcctcctgacctactgctttcagtgtattccattttcttgaactattaatgtttctctaggaatttttgtctataataaattattttgattgcacatcattttcaagtattagttgtacaccatttgtgttaatagagttagtttatacctgccattaattcaattctgcttgtactttatcttagtatttacttcctctttaagtgcagacttttgttttcacacttttttgtattaaattttactatttgaggagagaaccaaattttatcattgcttgtcaaggagttcttgaaaggaggactctcttgctttttactgtacatggtgggggaaggggaggtgggcagtaattagatatctcccaagaattaagaaataatgacaataaaacatttcagaaagataaactattaaagcagaatgcaataattataaggagggcagtgaaaatcttaatgagatagtttttcccagtgcgagccctacctgactgactgtattcgtaaattaaagaaaggatgtgtcaatgcctagaaggctttgaaggctttgtgtgtgtgtgtgtgtgtgtgtgtgtgtgtgtgtgtgtgttgtgtgtgtgtttagtttatgtgtgggggaggagggagcaaagtgtggtatcagtcagcaatagaacataagaagagtcagaaggtcaaattttggcagtgatcattcaacatctgatggttttagtggaatcataggtttggccaaagagccaggtaataggattccatgttcaggatgaatgaccactgagcagatatgtacctcaaaccatcttagcctaatgccattaccctttgaaatgatataacaaacttcctggttctgatctcggtgctcaccaagaaaaattaaccttaatatttgacacccactgcagatgtgtccataggggaaagcatactggtcatgaccttacaagttctgcaacagttttatttctcagtatacattggaagaatcaggaaatattctcattctgctacttggatttttatgagtttgaataatttgaatccccttctgagaatgattcactgctggaatgtggtcaaatttctgaggtaacagagctgagggggctgccctggtgaatctcctgcaccccatgagtccttgggtagctaagcagctggtatctcctggtgacactgaccaccccatatgtgactccattttaaatatcctacttaattgtttaacaaaacacagctttttgtccccttatagtttaattcattctcttctagcaaaaaaaaaaaaaaaaaattctgaaagtcaatggaaatcaagccaaaattctatataaaccctgttccccttgtctctccttctttcctctctccctcctctctctctccttctctttatcccctcctctgtccctatctctctgcccttttatatatttaattttcttctttccttctttccacttgtcttttttgagcaccatgtgcgtcagacactttactaagtactaggaaaacaaaaaccttctgattttgtaggaagaaagagagacacaaatctgcagcaagttgaaatatttttcatctgtggcatgaattcagtttaactccacatgtatgttttgtgcctctcttgtgcacaatcactgttttgggttttagaaagattaaaatgcgtaaggcttggcctcaagttgtttgtatctacaaagttatattaaatgtttagaaactgtaaacaaataattctctaagcgcaacatgagaaatattatgtgaactgcatgaaactttttgagacaagaagagatagcacttctagctgaagtatttttggtaaagtgagtggtatcaggttgtgtagtatgactgttttcactatactaaggttggatagagagttaagctaggcgactgaagccaaagtagtcttgtggggaagatggactcaggcaaatagagctggtcagaagtgattgagatgctagggcttagagatgctgtttcctcaaactcaggacactacagtgaaatgggtcaggagaacatagcattatgtcaagagctgtgagtctaggaagaaaagacaaggcagacttgggtagataattaggttaaagctgaagccaaaagcactttcctcagatagctaattactctgaaaatatttaaataaaatgataccttttaattactttttcttgaggataactctgtgttgtttagtcagctgtacctcaaaggcttgttcatatgactgcatcctctgccactcctccctcctcacttgtatgactgggggtgattgggtgccttctgcttttggtgtttttgaggagtgatgtgtatgtcattcaagctaatgcataaagtaagtgtagttattaagacagctgatgggggactagtgagaaccttaattcaatttaaggaattgaaacttaatttgtgtggtgatgtgaggactttgaaattttatcagtgaaggccatgatcaagagctgtattttagaagattatgttaccaaaagcaagtgtggatacaggagaaaatttatgggcatattgcatcatcttgggaaaagatataaggatggccaactagagtagttgcattctgcatggaaggtcaccttcatgggtcatggtggaggtaaaattaacagaagttggtaatgaattaactgtgggcaacaatgggatgcaagagtcatgacattcaaagagcttgaatccaggtgacaagccagctactgtagaaaggaaggtaccattagcagaggtagagaagagagcaggtgcagaaagagatactaaattcagaaatagaaatttcagaactgcaaaacaaccttgcattttacagctgaagggctgcctgtacaactcattgaccaacgggagatctaccttcataataaaatatatattcttttgcctctctcttggaaaagtgagtcatttactcaaccatgtgttgatatttaaagggcttgttatttgctaatggttgttttgaaaatcagtgagattcagactagatagaaatgtcctgtgttgtatttaaagaaaataaaaccataattttaagactgaaaatatctatccattatgatgccatgctcaacccatatactaaaaggtgttttgttttataaaatggtgctcatttgcattttaagtctgaatttttaaaaataatatttgtacacctgttatatgtccaaattaagacaaatttgtttaattatgattaaaggaattgcaagtgtaacattaaaaaaagatttaaattgccaaaataaaattttatttgaatttctaaatcacatatgactataaaaagcatcctgtgtttactgagaaggaagtgtcctgcctgaatacttcctattttgataatgcacatacaagtcacattcagaaagactagaaagcaaggagctacagatctagctaaattgtaatttattgtggaagatacaatcatcactcaccttggtcagggcatgcatcatgaagctgatagttaacaggttctaagttatatttcaaaggaaaaataatagacttggttgcaacatgaatgcaaattatggctctgtactctcccaaatccttggctttgttacctccagagaattcagctgtgggatttcagacccatctagtgtgtgtttctatgattttcagttgaatcttgacaagtatgattattcagattttttgtactgtctgaaatagaaatatgttctgcatcataacttagcaggaaagtaggaaggactcttagatctttgaagcagccatgatagcttatagtgaaacttttgacataccagtatatctccaaaagttctaggcaaatgtgtaagcaacataccctgaaatagatgagatggaatatccctgaaactcatctatttctcacaattctgcttggaactatatatctcacattcatcctcaactataaattaattgcataaaccctgatacacatagaaaaattctaaagttattatgtcataaaatagaatggttaatgacacagtgtcatcctagtgacctagtagtgtaactggtttgttgctgtcataaaataaaatagtctatcatctattttcaactgcctcctttatattgagtcttatgaaatgcttcagtgtgagagacaataacatgctgaaatgggaggaaaacttgaagtgaaacttcagttgaaaaaaaatattggacttgaaggcttaaagaagatgataaatggcattgaagttattactatagaaatgaaagccaaattttgcctgttttttgaaagtattgaaacactgggaaggatctttcaaaggcgagtttggttaggaagataactaaagacaggaaaggtaactgtgtttaaagtcttacaaagcaaattgcaaatattaattctaatattgtcaaaaagaaccattttatattaacttgagcatgattagaaagtatttagaacgtaatgtgtatgttactttccttaacgtaaatgttcctaccctacagttgctgctaggatacatgggactttttccttaatttctttttaatattattcattagtttgcaaactgattagtccataagattcgaaagtgtaaataaagtaaaagtgggtggtgccccattgtttgaagtgtctgatcaggtactgaataagtagaggagttggttccatttgcgcatcctcgggggttgtacggtcatatctgcccagcccgagtgtgtactcatctgaaatggagctagctggttatataagaccctgaatcaaccagcgaggtgactcctctgctgcagattctgctgagaggctgagagtacatgtgggtggacaaggatgacactagtatcactccaaagattaaaaatattcctcttcagacttggagaacctcaggtttcaatccaggattataatcaaggccacctgacaagccgactgagtcaggaacaaatagtgccatacaatttctagacaacagagaggttatctcttccctcaaatccatttcactactgagttatacctgaaatctcattcctggaggaatcattgtttacatgcaggctttgaaaactgatttttaaaaacaaacaaagccaaaaaataaaaacaaaaaacaaaaaaatggaaaagtgaaaaatccaacatttgattgttttctgacattttatgtcttcaatttaatatagatctaattaaatgtatatatattttggtaaggagataggcacagcagagacgggtactgggtaactgtggagagagggaaggaaagagtcaaagaaagcagctgtgtgtgcattgagctaggtgcttccaaaagacatggcctcagttagtcctcacaaaaggcaggcattatgggacctatttatatggtccagaaactggggcctacggatttaagtagtttgactaagttcattctgaaaattagcaatagatcttaatatatccaactaatgcctgtctgactcgaaactccaccatcatttcagtgcctgagactgcatgcaactgggaggtcaagtaggacagagccctggactccatgagcccctctgggtgacttaggctaatggggcatttttttaactggatcaagtctgtgtgggattcttggtgccaatgagcttttaagccgagtggttttcatctccacatggacgtgccacctggggcacacgaagactgcgtggggtgctcctgtgtgtgaagactttgggaggatgagtttcagatcctcagtttccataaaatccatctgcctgaaatagttgaagtgagctccctttcccacatctgaactctaaattccattctcccactctgcaaagtaaaaggctaactctcacccacccctcattttaccatgggatgtttggaggggtaaaaccactgcagcaccaaagaaaggaaactttcaaaatactgatgctagtatcgagagtgaatgatttgcagtgacagaaaataaaaatcttaattacaggtaaattgtttctaagaagtatgatcaagtgagaaaaaattttcagaaaaaaaaataaaggagaatgttctatgggggaagtaaaatgtcaacatgacttcaaagagaaaaaggaactacataagatttctgactttcgaagacttccttcatgtctttttgaaatagatgatattgattaattcaatggatacttttaaaagagttatgtagcagttttattttaaaatgtaattaattagagaacaatggaaataacaccttttgtgactgcttattcttttggatgtcagtcacataaaaattagggtttggaagaaaatattaggctcttaagcaaaaaatattgatgagcactgtcaattctggctgcccttggattgcatgagccacttcactggcatcttttctatcaccaggctagacaggatcaactttgggaaaagagagacaggcaaatatgcaacctcctcagcatgacttttacttacacaatttaaaaggtgtggtggggccaggtgcgatggctcacgtctgtaatactaacactttggaaaactgagtcaggaagatctcttgagcccaggagtttgagaccagcgtgggcaacatagtgaaaccctattgctacaaaaaatacaaaattagctgggcatggtggtgtgcacctgtggtcccagctacctgggaggttgaggtgggaggatcacctgagcctggggagatagaggctctagtgagccataatcatgccactgcggtacagcctgaagcctgggtgacagagtgaaccttgtctcaaaaaaaaaaaaatgctgtgatggagatgtgggagatattctgagtttacaattgcaaggcttatggtccccaagaaacccctagaagaaaacagagagctcgaagttgaatatttaaacttccttctaattaattgtaatatatgtttccacctacagttttcaggagagaatagttgacagttggcataagcaggaatgtaagaaaaaaaaaactcaggtgaatagtgagacaacatggaaacttactgagtttaaactatcaattcctatcccccattctattaccaagtattgtttccagaaaagaaaaaagaaccacttctttttttctctgtctctattaaaaactaattgtgaatgtatgcctttaatacataaaattgttgtaaagcactaatttatgtaaaccctctcaccctgtttttgatcaaatagataatcaagaatttcctttaggaaatcgttctgcagattgaatgaagtgaggttattgctctaagtcatttaaacaatgaaagttgtgtctttgaaatactaatatattcattcttctttcagaatcctatttagaattctgttttttcttcttccaattttttctgaaagctgaaaaaagaacaataatgcaattatgcatgtattgatgtacaactggcacataaacttcactaggatgtaagttggaatgttttcttagaagagcaagtactcagggcataaatgtcagcaattttgaaaaagctattattaattataaggagctcaaggggaaatagttgatattccctatggaaataatagatgcaaagggatgaatgcaaaacaggtttgattctattttgggaaatttaaaaaatatttcacttacagttccaaaagacatataagagtcctttcaaaaactgtgttataagaatttcagcaccatttttcaaagaagacaaacagcacaactgttcacaaggcactaagttcacattcaggccaaatatatttatgacctgaatattccatactcattcatacatttatttattcattcacaaaacatttactgtaaacctactatgttcaaaacaccggagacattgctataaagataaagcccatttagtcacagagaggaacacaaaagtactctcaattaaagagaaataaaataaaatgtataatgcatttttatcattatttctcctgataatcatctctttatgttagacagattataaacatcctacagtgggtgaatctaccttctgaataactatctctcaagtttcttcccaggcactcagaataagatcatatgtttagggaaaattttaaatattccataatgtaacacaatattgaattaaatgtataacatggagctggatgaaaacttttaaattgttaagttgctaggcaaattttagctcttttaacatttaaaaccaccccagaaaatgctcctggtgtattaaactgtcattctgctgacataatccagagtcatatctggctacagttacagcctgtgtaacctggagtgccattgtccaaaattctggtcaggtccgattttgcccacctgaactgaacaagttaaaagtcctccttcttgttatggtaatagtctgaggtttgcgatgaaaccggacttacttccttgattctagtgtattccttgtagagcaagcttgattctattgacaggaagctgatctttccttgtgaaaaggactctgctttcaaatatttcctggctccaatttgagtgttagcctgtaccacacacttctccctgcttggcagaagtagattctaagcattaggtcactcgcttgtcaagctaggttctggaactttgtttgacagtctttagttgaggagaatcctatgcatttgagatgcccttgtggtgtttacgtctttctgaataacatgtttgccaccaataatcaaaacacagcttaccttgcagcagatttttaaaacatacactttgtgatgtatttaatactagccaactattatatgatgggtatctataatcataaacactgaacctaatattctcctgtgaagaaaaactgattcaggagtttaaatcttgagagctctgattgtggaagttgcaggtgagatgatttgtccagtgtgcttatttccaccagctgtgctcagcttataggactttactggggatataatagcctgatgtttggtataaatagattgcaaaggaagacttaatagattttttaagacagagccatcacgcaggacacatctcttgtttttctaacaaggatagcaaatccattttagcacattatctaagttacagctatgggttaattgtacattatagttatttgaaaaagcgactacaaaggaaaatcttgtctaaaatggaattcatagaaggctcttatatagcaactttccagagttcaactacaagcacaaattgtagtgtaaacataatgccctgtgaaatattattttagcccatgccatggcccacttgtttagtgtctttattttaatttccagggtacccctgggattcgtcaggatttattgcaaatgaaaaagaaggatgatctttaatactgctggggtccctcaatagttcatagtatttcatagaagttgattttgcaagataaatctttttgaaaagttgactatcttggaagttgaaatgagagggtaacccagcttcaatacctaaaatgtaaatgagagaagcagttattattagctttggcaaagcagaaatcagggatgtggccatcttgatctagtgcaccaatgtagtgtacatctttctgccttagaggctggtgtccagttaaaaaaatgagttgttttacctgaaatgcagtaactttgcaaaacaagcagcagttttgaaagccaattgatatattttttatcaaatttatctctggtccaagtgctcaagtggtgtttgtggagggagagtagaagtatgttagcacttattctcaataacttttgcagcaatgtgcctgcacaaaacaattttcttcatggcttgatatggtttggctgtgtccccacccaaatctcatctttaattgtagttgccataatcccacattgtgggagaaacctggtgggagtaattgaatcatgggggcggttacccccttgttgctgttctcatgagagtgagtgagttttcatgagatctgatggttttataagggacttttccccctttttctgcacttctccttgctgccaccatgtgaagaaagacatatttgcttcctcgtccacaaggattgtaagttttctgaggcctccccagccctacagaactgtgggtcaatttaacctctgtcctttataagttaccaagtctcgggtatgtctttattggcagcatgaaaacggactaatacagtaacgaaggaaatgctcattgtagcattttggatttttttttattatactttaagttttagggtacatgtgcacaaggtgcaggttagttacatatatatacttgtgccatgttggtgtgctgcacccattaactcttcatttaacattaggtatatctcctaatgctatcccccccctcctcccaccccacaacagtccccactctgtgatgttccccttcctgtgtccatgtgttctcattgttcaattcccacctataagtgagaacatgtggggtttggttttttgtccttgtgatagtttgctgagaatgatggtttccagcttcatccctatctctacaaaggatatgaactcatcattttttatggctgcatagtattccatggtgtatatgtgccacatttttttaatccagtctatcattgttggacatttgggttggttccaagtctttgctattgtgaatagtgccacaataaacatatgtgtgcgtatgtctttatagcagcatgatttataatcctttgggtatatacccagtaatgggatggctgggtcaaatggtatttctagttctagatcctgaggaatcgccacactaacttccacaatggttgaactagattacagtctaaccaacagtgtaagtgttcttatttccccacatcctttccagcacctgttgtttcctgactttttaatgatcgccattctaactggtgtgaaatggtatctcattgtggttttgatttgcatttctctgatggccagtgatgatgagcattttttcatgtgtcttttggctgcataaatgtcttcttttgagaagtgtctgttcatatccttcacccactttttgatgggttgtttgttttttcttgtaaatttgtttgatttcattgtagattctggatattagccctttgtcagataagtggattgcaaaaattttctcccattctgtaggttgcatgttcactcttatagtagtttcttttgccgtgcagaagctctttagtttaattagatcccgtttgtcaattttgacttttgttgccattgcttttgatgttttagacatgaagtccttgcccatgcctatatcctgaatgggtattgcctaggttttcttctagggtttttatggatttaggtctaacatttaagtcttcaatccatcttgaattaatttttgtataaggtgtgaggaagggatccagtttcagctttctacatatggctagccagttttcccagcaccatttattaaatagggaatcctttccccattgcttgtttttctcaggtttgtcaaagatcagatggctgtagatatgtggcattatttctgagggctctgttctgttccattcatctatatctctgttttggtaccagcaccatgctgttttggttactgtagccttgtaacatagtttgaagtcaggtagtgtgaatgcctccagctttgttcttttggcttaggattgacttggcaatgtggactcttttttggttccatgtgaactttaaagttgttttttccaattctgtgaagaaagtcattggtagcttgatgggcatggcattgaatctataaattaccttgggcagtacggccattttcacgatattgattcttcctacccatgagcatggaatattcttccatttgtttgtatcctcttgtatttcattgagcagtggtttgtagttctccttgaagaggtccttcacgtctcttgtaagttggattcctaggtattttattctctttgaagcaattgtgaatgggaatttactcatgatttggctctctgtttgtctgttatgggtgtataagaatgcttgtgattttttgcacattgattttgtatcctgtgactttgctgaagttgcctatcagcttaaggagattttgggctgagaagatggggttttctagatatgcaatcatgtcatctgcaaacagggacaatttgacttcctcttttcctaattgaataccctttatttcctctcctgcctgattgccctggccagaacgtccagcacgtcccatgttgtccaacgtcctatgttgaataggagtggtgagagggcatccctgtcttgtgccagctttcaaagggaatgcttccagtttttgcccattcagtatgatattggctgtgggtttgtcatagatacctcttattattttgagatacatcccatcaatacctaatttattgagagtttttagcaatgaaggttgttgaagttgtcaaaggccttttcttcatctattgagataatcatgtggtttttgtcattggttctctattgagataatcatgtggtttttgtcattggttctgtttatatgctgtattacgtttattgatttgcatatgttgaaccagacttgcatcccagggttgaagcccacttgatcatggtggataagctttttgatgttctgctggattcggtttgccagtattttattgaggatttttgcatcgatattcatcagggatgttggtctaaaattctctttttttgttgtgtctctgccaggctttggtatcaggatgatgctggcctcataaaatgagttagggaggattccctctttttctattgattggaatagtttcagagggaatggtaccagctcctccttgtacctctggtagaattcggctgtgaatccatctggtcctggactttttttggttggtaagctattaattattgcttcaatttcagagcctgttattggtctattcagagattcagcttcttcctggtttagtcttgggagggtgtatgtgtcaaggaatttatccatttcttctagattttctagtttatttgtgtagagatgtttatagtattctctgatggtagtttctatttctgtgggatcagtggtgatatcccctttatcattttttattgcgtctattttattcttctcttttcttctttattagtcttgctagtggtctatcaattttgttgatcttttcaaaaaacccgctgctggattcattgattttttgaagggttttttgtgtctctgttttcttcatttctgctctgatcttagttatttcttgccttctggtagcttttgaatgtgtttgctcttgtttctctagttcttttaattgtgatgttagggtctcaattttagatctttcctgctttctcttgtgggcatttagtgctataaatttccctctacacactgctttatatgtgtcccagagattctggtatgttgtgtctttgttctcgttggtttcaaagaacatatttatttctgccttcatttcgttttgtacccagtagtcattcaggagcaggttgttcagtttccatgtagttgagcggttttgagtgagtttctgaatcctgagttctagtttgattgcactgtggtctaagagacaatttattataatttctgttctttcacatttgctgaggagtgctttacttccaactatgtggccaattttggaataagtgcagtgtggtgctgagaagaatgtatattctgttgattttgggtggagagttctgtagatgtctattaggtctgcttggtgctgagctgagttcaattcctggatatccttgttaactttctgtctcgttgatctgtctaatgttgacagtggggtgttaaagtctcccattattattgtgtggtagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttgatttaaagtctgttttgtcagagactaggattgcaacccctgcctttttttgttttccatttgcttggtagatcttcctccatccctttattttgagcctacgtgtgtctctgcatgtgagatgggtttcctgaatacagcgcactgatggggcctgactctttatccaatttgccagtctgtgtcatctgattggagcatttagcccatttacatttaaggataatattgttatgtgtgtatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttttctgtaaaggattttatttctctttcacttatgaagcttagtttgactggatatgaaattctggattgaaaattcttttctttaagaatgttaaatattggcccccactctcttctggcttgtagagtttctgccaagagatcagctgttagtctgatgggcttccctttgtgggtatcccgacctttctctctgtttgcccttaacattttttccttcatttcaactttcgtgaatctgacaattatgtgtcttggaattgctcttctcaaggagtatccttgtggcattctctgtgtttcctgagtttgaatgttggcctgccttgctagattggggaagttctcctggataatatcctgcagagtgttttccaacttgtttccattctccctgtcactttcaggtacaccaatctgatgtagatttggtctttttacatagtcccatatttcttagaggctttgttcatttctttttattcttttttctctaaatttctcttctcacttcatttcatttatttgatcttccatcactgatacacttttttccagttgatcaaatcagctactgaggcttgtgcatttgtcacgtacttctcatgccatggtttcaagctccatcaggtcctttaaggacttctctgcattggttattctagttagccattcatctaattttttttcaaagtttttaacttctttgccatgggttcgaacttcctcctttagctcagagaagtttgatcatctgaagccttctctcaacttgtcaaagtcattctccgtccagctttgttccattgctggtgaggagctgcgttgctttgcaggaggaaaggtgctctgatttttagagtttccagcttttctgctctgtttcttccccatctttgtggtttatctacctttggtctttgatgatggtgacgtacagatggagttttggtgtggatgtcctttctgtttgttagttttccttctaacagtcaggaccttcagctgcaggtctgttggattttgctggaagtccactccagaccctgtttgcctgggtatcagcagcggaggctgcagaacagcagatattggtgaacagcaaatgttgctgcctgattgttcctctgtaagttttgtctcagaggagtacctggctgtgtgaggtgtcagtctgcccctactggggggtgcctcccagttaggctactcagggatcagggacccacttgaggaggcagtctgtccattctcagatctccagctgcgtgctgggagaaccactactctcttcaaagctgtcagacagggacatttaagtctgcagagatttctactgcgttttgtttggttatgccctgcccccagaggtggagtctacagaggcaggcagacctccttgagctgcggtgggctctaccgagttccagcttccaggccactttgtttacctactcaagcctcggcaatggccgacacccctcccccagcctcgctgccgccttgcagttggatctcagactgcgtgctagaaatgagtgaggctctgtgggcgtaggaccctccgagccaggcataggttatcatctcctggtatgctgtttgctaagaccattggaaaagtgcagtattagggtgggagtgacccgattttgcaggtgccatctgtcacccctttctttgactaggaaagggaattccgtgaccctttgtgtttcctgggtgaggcaatgccttgccctggttcggctcacgctcggtgcactgtacccactgtcctgcacccactttccaacactccccagtgagatgaacccagtacctcagttggaaatgtagaaatcacccgtcttctgtgtcgctcacactgggagctgtagactggagctgttgctattcagcatcttggctccaccccaggattttggatttttggatttgggatgttaaactggtaagtatataatgcagtattccaaaataaaatataatttaaaatccaaaatgcttctggttccaagcatttcagataagggatactcaacctgtattggaaaaccatgttaaatgggcatcttcatacagttgctaaataaatactatgtgagggacctattctaagttgtaaagatcttgtaaaagtgaaaaaggaagttgcttaagctatttaaattggatcatgctacagatggggacaaaacatttgctgacaaacaaacaaaaacactccaaaacgtaactgataaagggctagtatccaacatatatgatgactctgaaaactcaacaatgggaaaaagatgtgaacaggtttctcaccagagaagatgcacagatcgctaataaacataggaaaatatgctccatatcatatgtcatccacatcataactcatcaggataatgcaaattaaaacaaagagatatcattgtatgcttattagaatggctaaattcaaaacactgacagcatccaatgctggagaaaatatgggacagcaggaactctcatccattgctggtgggaatgcaaaatggtagaggcattttggaagacagtttggcagtttcttataaatctaaacatgctcttatcttatgactcagcaattacatgccttggtatttaccccaattacatgaaaacttatagtcacacaataacctacacccaaatgtctacaacagctttgctcataattgccaaaacttagaagcaacaaagatgtcctttacagagatactctctaaaagaaaatgatatttattcaggagtaatattacaatgggattatgcacgccatagttaactatgtgtgtagtcaaaaatattgaggcacgggaaagtttttaaagacaaaatgaggtggattacataagttattttgaatcaattatccttggaaacaagaataaataacaagaatgctgtgagtccaaggttggacaggcagttgctgaacaggtgtcctcgcagaagtattttctgtgtaaagctgtggtggcctttgtgtaaagttgtggattttgccatcttttgtggtagttcttattatcagggatatgtgcatgagaaccctcccccagtggctttccctctctccatttgtcaatgcttgacacaagtgcctccatttagactctgaaaactttcacaccttcagtaggtgaatgaatcaactgtgatacatccagacaatgaaatattattgaccaatacaaagatatgagttatcaagccataaaaagacatggtgaaaccttaagagcatattgctaaattaaataagctaatctgaaaaggctacaaactgaataattccaaatatatgacattctggaaaagacaaattaggggcacaataaaacgattagtggttttaagggattttggggtacagagggagggagagagggaaggacgaatagctgaagcacaacagatttttagcacaatgaaatgattctgtatgatattgtaatgatgggcacttacctttgtcagaacccatagaatgcccaccaagaatgaaccctaatataaactatggactttaattaacaataatgtatcaatatagactcaacaattgtaataaatgtaccacaatgttgctaaatcttaataagagtgtaatctgaggatccaggggaggtgaagggagaggatatataggaactctgtactttctggtcatatttctgtaaatgtaaaacttatttaaaaagagtattgaaaaagaaagaacataaatctttattaaataggctctgcagggtccctaaatagaaactttttaataatgattacgacctaaaaatatgtttataagtaataaaattacattaataaaatcattttattacatagtctacttctctcacactaatttcaactgacctttctaccaataattcaaaaccaagattgatttcattttaaggcacaaacaatggattgaattaataagatgcatattagaaatgggttgttttatcaattcttatgtaatgcatattttgtcaggaaatattcattacaagagagagctaaaacatgaggcaccagtcttttgaaattcccttaagttaaacaaaaattgccaggaaaagcagaaagaactatattccagaaaagttaacagaacaaggtacatttaaaccattttaactgctcactagtaagagcagtgggatctttgaagaataagtagttaataagtcacagtatcctacccgtgagaatgaaatgtaactttctattttgctaatggttcaaaatagcaaattggctattctctctctcggctgcaagcttgaaaatcttgaacatttgtgtttttactacttagaaaaagaaagatgcaatataaagagaatgtcatcctgcagtgtttcttcttcccaaagccaataattattttcaaatacatttttatttcaatactttttggggtacatgtggtttgggagtacatggataagttatttagtggtgatttctgagatttttgtgcacctgtcacccaaaccatgtacactgtatccaataggtagtcttttatcccttacccagctcccaaccttcaccctgagtccccaaagtccattatatcattcttatgcctttgcatcctcatagcttaacttccatgtagaagtaatagcacacaatatttggtttaccattcctgaattacttcacttagagtaatgtcctccagctccatccacattgctacaagagacattatttcattcctttttatagctgagtggtattccatggtgtatatgtatcacattttctttaatcattcattggttagatgggcacttaggttggttccatatttttgcaattgtgaattgtgctgctataaacatgcatgtccatgtgtcctttacatgtaatggcttcttttcctttaggtagatacctagcagtgagattgctggattgaatggtatttctacttttagttctttaaggaatctccaaactgttttccacagtgtttgtactagtttacattcccacatgcagtgtaaaaatgttcccttttctccacatccatgccaacatctgttgttttttgactttttaattatggtcattcttacaggaataaggtggtatcttatgatggtttcaatttgcatttaatttgcattttgcattttcttgtttgtttgaaattcaagtaactttaataattggtgatgtttagcattttttcgtgtttgttggctgtttgtatatctttttttgagaattgtctattcatgtcctttgtctgtattttgaagggattatttgtttgagtttcttgtagattctggatattagtcttttgtgggatgcgtggtttgcaaaaattctttcccactctgtgggtagtctgtttactctattgattatttattttgctgtgaaatagctttttagtttaattagtttaattagctcccatttattagttttattaattttgttacatttattattaattttgctatatttatttttgttacatttattgaaataaagataaaaatgtatttaaaaataattattggctttggaaagaagaaacactgcaggatgacattctttttatattgcatcttttttttctaagtcagtgaaagacacaaatatccaagagtggtaaggctattcaatgaggaaaggtcagtcctcaaaaaatggtgctgggtaactggatatctacatggtaatgaatgaatctggacccttactgtacatttgttacttataattttgttacattcgttacattttgccttactggacatttgttacttatgattttgttacatttctggaaaagtttttccgatgttatcttctagaatgtttatgatttaaggtcttaaagtctttgatccatcttgattgatttctgtataagctgagagatgaggatccagtttcattcttctacatgtgcaaagctcactattaaattattatttaataattattaattattaaaatatgtagaatataatgggtattttcaacttccctatgaaaataaattcagatgaagttggttcaaaaaactaaatgtatgtaccttttatatcttgagaaatatcactggcacattattcatactgtcagtgggcatttcagtttccaccttttggctattgtgaataacgctgccatgaacatgagtatacaaatatctgtttgagccactactttcaattcttttgggtataaactcagaagtggaattgctgggtcatatggtaattctatgtttatttcttttttgaggaactgcaatactgatttacacagtgtcctgcatcattttacgttgccgccgacagggaataaagatgctaatttgttcacatccttgccaacacttgctattttctgtttttgttttgttttgtttttgttttttgatagtagccaacctaatggtgatatctcattatggttttgatttgcattttcctaatgattagtgatggtaaaaaatcttttcatgtgcttattggccattcgtatgtcttttgtggagaaatgttgttttaagtcctttgccaatttttgaaacagattttttgttgttgctgttgagtttaggagttctctacatattttgggtattaacctctcatcagatatatgatttgtaaatactttgtcccattccgtggattgcctttatactctgttaatatagttctttgatacacaaaagctttaagtttccatgaagtgcaatttgtttgttttttcttttgtcacgtgtgtctttagtgtcatattcaagaagtaatttccaaatctgatgttgtgaagattttgctctatgttttcttctaagaatttcataggttagctgtaacatttaggtctttgatctgcttttagctaatttttgtatatggcattaagtaagggtccagattcattcattaccatgtggatatccagttccccagcaccattttttgaggactggcctttccccattgaatagccttaccactcttttcaacaatgtttgaccacatatatgaaaaattccattgatctttacatctgcttttatgccaaatgcactgttttgattaccatagctttgtagtaagttttgaaatcaggaaatgtacatcctctagctttgttctttttttatcgcgattgtttcggctacttcatgcccctgagattccatatgaattttaatttctatttctattaaaaagtcattgagattttgataggaattgcattgaatctatagatcatttgcgggggggattgttgacattttaatattgtcttccaattcatgaacatgggatctctttccatttacttatatcttttaaaattatttttagcaatgttttagagttttcattgcagaggaatcttttaaaaatgtaactattttaaagccattcatggggctttttcttactggtttgatccaactttgcattgcatactgatccatatattatgccaacttattccatttatagactgaaaaatgtatatcaattttgtacctgtgggttaaaacttcattagaacagttaaatgacatttaatgtagtacagctggaaaacaatgccagtgcacaaatctattactataataatgtggttttgaattacatttcacacagctcagtattatcttctaccaaatttacaagtccaatgaaaggtaatatagttcaatatacattaacaattatggttcttgttttcttacttaacggacctgctatttcaggtattgttttcatttaccttttaatcagcttaaatgttgtaaaatacctataatgagaggggtcgtattacaaggaaagcatgagaaactgtgggtagcaaaatttgtttggttagttttttttctagttgtaaagagatgatgttgatattatctcatagagatttcctgttttctcagtcttctgggaagacagaaccatatgccactaaaccaatcctcattgcaccagatgtcttatgtaaaggaacaccttaacatctcagagattatacatttttaggaatcaaatatgttaaaaggattaaaaaagatattttacctctctacattctccagagtaattagcccagaactttgcataaatgtgtttactttgtattcatttctttatttagtaattcattctcaaatatttgtttagtaccttatatgggctaattgcactgctgtgcattggtggttgtgggattcagccttcaagataccacccaatgatccctgtctcctgctacacacccttgggctacgttgcaccagggttggtctgtgggatccatagaatattgcagaattgatggtatgttacttccaagataggtagtaaaagatcgacttccatcttttgcattaccttttttgggtcaccctctctggggaatccatgtcatcagcagctttgtgaagtgtcccaggaggtgaggatctaaagccttctgccaacagccatggaagtgagctgagaagtatatcttctcagcccagtcaagtttcaagttactgcagaccctgctgacactctaattgcagcctcatcagtggccttgagccagcaccaccaagaatagctgctctagaattccaaactctcagaaactgtgagaaaataagtgtttactcttttaccctgaaaaatttgaaagacttttctatacagcaatcattaattaatacagagatacatgcatgaacaagtcttttcttaatttcaatttttatcatggattaaagggtacatgtgcaggtttgttacatggataaattgtgtgatgctgaggtgtggggtaccaatgatcccatcacccattccggaagaatcgtacccaacaggagtttcttcagcttacattccgctccttttctcctccagtgatccccagtgtttatcattcccatctttgcaatcatgtgtattcaatgtttagtttccacttataagtgagaacatgtggcagttggttttctgttcctgtattagtcgcttaggataatagcctccagctccatcagtggtactgcaaagggcatgattttgttcttttttatggctgcatgatattccattgtgtatatgtaccatattttctttatctagtccactgttgatggacacttaggttgatttcacgtccttactattgttaatagcactgcagtgaacatacaggtgcctgtgtctttatgagagaatgaattattttcctttgagtatatacccagtcatgggattgctgggtcaaatagtagtactattttaagtggatgaacgattcttgtcctgccttcaaggagctactagctcagtgaaactggtgaactgttgatttaccactaaaccaagggtagataccacgacagcacctagatgcagcacctatctcagtcttggtgacaagaacagccaaatgaatgaaagattcttaatttgtggctccaagaatgaggacgaggaagtagcaagagaaaagcatggacgattccagatagaagagaaagggtgagccaaggttgaggttagggagaggtgagtacagtagtttccaggccctggtttcatgtgggcaacaggggtgatgaataatgaggatgggggggtgagctgggaacagatgaggaagaaaagtatatatcacaggaaggagttagaggagagccactgaagatttttaagcacaaacatgactaccattcagagtataagccagggtacgtaggaaacaaggaggcactggctgcagaaacaggaaaaggtcctgggagtctaagagagggtagtggcagtaggaaagagagggagttgagtttgaggcatgttaagaggttagaatcgacagatttgaggctgaaatacataatttggcatttttgtcttttaatttaccccactaagacccctggacacttaacccatacctgcccctcctctagtacggccatcttggtgattgacaccacagatcactcagtcgctccagatggcaacctggacatgactggaaatacctccctttcccttgtaactgtatccagttactaacctaattttacatatctaatgcccaagatctttctaattagagtgtcccttcccttctttccccacctgagtagtgttaagtaaacccttgccacctcttccctcaatttttgtaatggttcctaacagtttcactcctagccataccttctttgcatgaattctctgtatccctaccaggcccattcaaaacactcatatgagtgttcacccaccctgcttagacacattcactggttcttctgccactgtggacacagtccacatgctttggcttggatgcaaatcatttttctctaatctctagacttctctctctctctctttctctctctctctatatatatgtatgtatctcccttcctccctcctcttctacctcctcctcctctctctctctctctgtctctctctctctccatatatatatatgtatatatgtatgtatatcccttcctccctcctcttccaccccctcttcctcccccccaaagccctattgtatagccatattaaactactggggtcacttatgtacatttaaaccctttcttttctctatatggatcttcactccctcctgtccccagctaactcctacatgttaggagttagaactcatacatgttaagacccaactgtgtgttgcctcttcttggatacataagctgccacctgatgcctatctcccctagctctcacctcactatattcaatttgtgatttgcatccagtctctcccacaagtttccaaactccttgaaggcagggaccacacctcatgtgcctggcaccgtcagcgtagtgtcttgcataaaatagacactccacaaatgtgaaaagctagaactgagcactgcattcaaacattctgcttagtgtcctgaacaatacagtccaaacaggaaagtactgaacattaagaacctttttatcttctttaagagttagaaaagcttgaataattctttcttatctggtataggaaaatttttgattttttatattagatacactggaaagtgaactatcaagcatgaagagacaaacatctactatttgaacttttgacaactaatttatagctccaggaccaataggttattacgtatgttgtccttgtttgtgcaagaccaatcaaataccgctttgtattaatacttttaaaaagattaaaattctgtttttttcatgtttaactctgtcttcagatatgagtcacctaatgtcttctttgagaggagattactttgaagtctgggggacatccccagctagaagacctgggcagaaatatgctcggatgatcatgatctgaattcaaagggaacaattaaggaattatttccattttgattctaatagcaagcttttctacttgttgcccttcaacctgtctgcatgccagctgaaacttcaatagagcctcatgacagagctgttaaaagactttgaaaagggaacgtgtgaaatcataaatgcttcagaaataagataatgtttctcagtccattacattcttaacctcttgtttctgcttaacggacttcgttaaaggtcagtgagaatgttttaacagcaaatgcttgagacttccaagaacatattgccattctagatatccattgctaataaagaactggtttggtatattctgtacttatattttcagtaaaaataaaaagtcatcatcagaaagacttgagcataaatctaaatttcaaatctttgaattagtatatatttgaaaatttgtaatctggtgttacttttccaattaggaaaatgaataacataacatctttataatgcattacagtttatgatgaaaatttctgtatgcttttctcatttttcactatagtggttgagtgacatggataataatgtaatttcattttagatatgaggagactgcagtccgagaaggttaggttgcttaactaaccctgctaacctgtgaatgagctgtgatgtgatcctagatttgcaatcacaaactgacaaaattctgttctctattgaatgcttctgtttttgtttttatttgtttctaagaagttttcgaccaggcactgtggctcacacttacagtctcagcacttccgtcaagaagccaagataggcagatcacttgagcccaggagttcaagaccagcctgggcaccatgccgaaaccccatctctacaaaaaatacaaaacttagctaggcattttggcatggcctgtagtcccagctacttgggagaatgaggttgcggcgacagtgagttgtgtttgtgccactgcactctagcctggcagacacaatgagactctgtgtcaaaaacaaaaccaacaaaaaacagttgtttttccagcacaattcatgagattgttttttaaaatgcacaaactagtactttaaaagatatttttgattttccattacacaagtacagaaatgtgtaatttctctatcaacttttcccttaagaaattaatttttttcattgtctgaaagagatagagttacctgtctctaaaggatattttcctcaagtacccacaggtaattttgaatttgtggttcatttcacctttttatgactccagaagttaaatgattcttggctgtacatcaaaagatgattatgtagttattatttatttttatagctcagatgaacctggtactagcttcattatagtgcatgtcccatcggccaaatgaacacaatctggaaatatgacatgcatttttaatagtaatagggcaataattctgcattttgtgtaggtgtaccaggggctacttaagtgaggtttaatgtcaattaagaaacactgcagtgcccttactggaatcttgtaatagtcacatttctctcgttgttttatgaagtcaggtgtaaataatcactttagagggagacttactaagtatggacctgtgcatcatttttcttagctatatatatgaacgtatagtaaacataagcagcacaaacttttcttctgtttctagagtgacaggcattctgtagtattgataggatataaatagacatcattaaatgctttacccatggctttgggccctagtatcattatctgaaagcatttagaatgagtaactaaaagccaagaaaatttacaagtcgcattttggagaataattacagttatccatcaccaaactgctggcaagtagtggcattgcctcattggattttatccctttttatgactctggctgttcctcaggtgtaaggtctataagccatcaagtggattggaagggccaggaagaccagaggcgcagaatgacttcaagaaacagcatataaaagagtattggcacaatatggagaagcagctgaaatatttggaatttgtatgtgctgagccgtgtgaagattgctactcagtattaatcacattccaaaagataggttatcattagcatttataataacatgtaagttctactctgtgctacctgatgtaggagactttattagttactcatggctgcaggaacaaggtccacaaatcaagttgcttaaaacaacagatatttattcacttacagttcttggagctagaagtccagaatcaagatgtcggcagagccatgctctagggaaagattccttctttgtttctggtggttgtcagtaatccttggcattccttggcttgtagatgcatcactccaatctctacctctatctttacatggcctttacctggtaggactaggtcgaaacttcccacactatataaggacaccagtccttgcattagaacctcccataatccagtaagactttaccttaacttggttgcatctgcaaagaccctttgtccaattcaacaaagaccatacgtttcctaactcaatggctttggaagttagtgatattgaaaatataaatgtgtatttttagaaccagtatgaaacatgtgtttattatctattgctacataacaaatcaccccaaaacttagtgccttaaaacaacagccgttttgttatatatcaggattctgtgggtcaaaatttggatggggtttggctgggcaattctccatgtggcatccctggtggtatccagttaatggcttggctggaaagtgaaaaatggttttgttcatagctagaaggctgggcttgacttaatctctctcattctccctgtgtgctcaggacctttccacacactctctctagcagagtaactgtatatcttaaatgacagttcaaggttttaagagtaagtaattaaagagacaggaactgaaaactgcttgtcattaataagggacaggcccccaaactggcacagcatagcttccataatactgtttgtcattatagtcagagcataccttcagatttaaggggagaggtgtaactctctgtggaaagactattgttcaccttttggccacagatagcttacatttctcccatctttgaaaatctcatgccagcagggcacagtggctcaagcctgtaattccagcattttgggaggctgaggcagatggatcacttgaggtcagaccagcctggccaaaatggtgaaactccatctttattaaaaatacaaaaattagctgggtgtggtgactcatgcctgttattacagctacttgggaggctgagatgagagaactgcttgaactcgggaggtggaggttgcagtgagccaagatcattgtgccactgcactccagcctgggtgacggagtaagtgagactctgtctcaaaaaaaaaaaaaaaaaaagaaagaaagaaagaaaagaaaatcttattccatcagagccctgccttgaatttaagaagccgctggtaaaatcagttctatgtagagatgagattctttgtgtatattttctctccatctgaagacctgtagaccataggaacaaattttgtgccctccccacaacatataatggtcagagaggagtagattctcctctttaaaaaagaaaatgggaaacatgttccacagtaattctaaaatccaaccagatgcaggtcactagatccttaactaggctctagtcctgtttcctggaaactattgccctggctctccgtttctctcttgaatccatcctccttttccataaaaactttatgggacccctgtgtatcaaataatgatccaatccatcagagaaaagccatgtacacatttggttctgacatagtccttttttgctggaacttagggcattctggggaaatgaaaagaagccttctttctagttgaaagggttcatcaggcatccttaaaattcacagagacatatattatgatttctataagtccaattaggcttaccttcagatatttctgagaggtcaacaaaggaacatccatgagctttattttcctaaaaccatattgtacaagtagcagcagcctggatttaatctttgccctgaggtcatttgtaactttgcaagtctattgctgggagagcctgggaatgagaaacaattttaccttcatattcagcatgttctggtccttttttcctctgaatcttgcttagaaacagaaaatttcttctttggcttatccctttccatgttttaccataggcagctaggaaccagttggcgctttctccattttgcctgttcatctttcttgccagacttttgtggatgtccattaagtttcttatcacgtgcaacattaatgccaaactttctgccagtacagaaaaagtatcacatattttctggcctccagtaacatattttcattgtctctaaaggcttcaccaacagtcttttcaaggcccttggggcttttgctaacagtctccttgaagtcctcttctttccactaacagtctctatgaggcccttctagcttctgtccactgcttgattccaaagctgtccacacatgtgacaggttttgtacagcaacaccacacccccaggtaatggattttgtcccggttttctactgttgtgtaaaaattgaccctaaaacaagtggcttgaaacaagcaccattttattataccttatgacttttgtagactaaaaaacagcctgagcttgactgagagttccttctgctccatgtgatgccacttgtagtcattcagaggtggctgggatggtccacaaccgaagtcagcaaagttttttggtgaagggccagaaggtatgtattttaggctttgtgggctgtactgtttgtcaaagctactcagcctgaccactgaatgacaaagtcatgtggttgctcagtctgctagtacctggtctagagaacccaagaaggctaacacatttcatttactttcatgcagatggctagagagtgggctcagcccatcttctctccctccctcggtagttgcagggtgtctctgcatggtttctccagcaaaacagtccactttctcacatggacgcttaggccccaagaatcagtggtccaacaaacagaaagtgaaagctgccagcctcatgaggtgtaggcctagaaatgcacaacatatcatttctgccattttcactggtcaatgcaatcatagatcccttcctcccatattgaaaaggaagagagagaaatccttactggatattttgcccggaaatggtatcagataacttgtggccattcaacacaatgatcaccttagttcactgatgaataagacatttctctaccttcgaggagcttacattataattggaaacagatatgaaagcaattttctggagcataggacagaatgaagtatatcaggggcaggaaaaaaaaacatataggcactcctataaggagtgtcatgaatttgaatatatgcctgtgttttacaagtagttgctagcccttgtttctgtctattttactgtcaagtatagtacatatatatataacacaacacacataacagacacacactctcacacacatatgtgtgtacacatatacaaacaacactcacacatgcacagcacgtgcacacaccaactcacacatgaactttcaaacatgtaactgaaacaagtttcttcacatagcagttactgtaagtctcggcaatgtacttggttatattcctttctttctattatatttaatttttagaaattctgatcattgtccactgaattaatttcacaactgcagtttatttcataaactgaagtgtgaaaaacaactggtcaagaagatgcggaggtcaacaagccttgtgagtcgctgttgcacaataagttattgttaaaatttattctttacaggaagatctgggaattgatttaacaaggggataggaaaaaacttttcacaaatttctttctcagtggcttctttgatagaatatatgtccagtatattttgatatatgttatttattatctgccaatgatgtgtctgtttattttgagctgctttggtaacacattagtttgaagtagccataaaaccttttaaactgtgataggttgtgaaaataccattaggtccttgtagaagttatcatatttcatgatgtgaaaagtttataatttttctcgtttgtttagaaactatattcatgttgatgacttgaaaaagaaaaaaatgggaaataattataaaataaattatactataccattaatatacaattataaaataagagtcattctttagttttccagtaaatgagtatttacttagttttgaaatgcaacagtgaacaggacaacacaaatcttccattatggaacttatgttctgcaaggtcaaatagaagaaaacaagtcaacagccaaatgaagtaattgtgagttgtgatgaatgccatgaaaggattaaacatgagctgaaatagaaaattttaaggtcagctcttatattagggttatctagagggacagaactaataggatagatataggtatatatatagagagaggggagtttattaagtattaactcacgtgatcacaagatcccacaataggccatctgcaagctgaggagcaaagaaagccagtccgagtcccaaagctgaagaacttggagtccaatattccagggcaggaagggtccagcaagggagaaagatgtaggctgggagactaggtcagtctagtcttttaatgttttactgcctgctttatattctagccaggctggtagctgactagatggtgctcagccaaattaagggtggatctgccttccccagcccactgactcaaatgttaatctcttttggcaacaccctcatagacacacccaggatcaatcctttgcatccttcaatccaatcaagttcatactcagtattaaccatcacagctcttgacacagggtggtcagagagaggctctctgctctgagtagttggcattaagaagaatctaaagaataagaaggagatgcctgtgattagaccactaggaagaatgttccagatggtgggtaaaacataatgcagaagctctggggtcaggatgaggttgctttgtttgggcaactgaaaccccagaatgagtgatacctagggagtgagttaagtgagagattgtctgagatgagagagaaaggtagacaggaactgatctcacagggcctactaggccatagtaaggcgtttagagtttctttccttagccagataggaagctattcaagtgtctttgcaggagagggcaaggtctaatttatattttaagaagctcagtctgactgctgcttggagattgaaccagagtggaacaaaagtggaagtggggtgtacactgggcttattccttttgaacgtccggggataaaagttcagcttctacactgactatttcctgtggaatttttggttcttgtaagttaaattgaacatagaaatatggagacaccttaaatttaaattaaaaaggcaagggttctatttagttttgtctaaactatcctgtaaatagcaatttgcaaaatgagattcatctttttctttaaaaacttgtagattcctttaaatttaattctgatttcctcttgaaaatggtaataattcctaagaggcgtcagaaatcaccatgtgtttatttacatgctctgtaccccaagttaaaaagtaatgtgcatatttttctaaagaaaggattttataatgtaagaacggtgggctgattgttaaagaaaaaaaatctaacatttgctgaaatggtaaggaagactttattcaggactattgtgataggtgtcaaaactatcagaattgaggagagaaatgggtctcaactgcaaatacatgcaaggacaagtagggatttatatcattaggacaaataggtttaataccttttcctcacccatcacaagggtctagctgacactgatatgggaaaagacagattaataagaaaagagtataacaaatttatttaacaaagttttatgttacatagaagcctgcaggaaaactgtatttttatgttttttaatgtattttttatgtttaggtttgatgaagaatagtcatgtagaaatataattggacaaaaagcatatgatgtaatgatataaacctaaggcaggggaaggcagccaggactatttattccaattcttcttggcctctctttttataattttttcctcctgggtatggggcaggtcacctatcaaatgagggtcttcaagggagaaaggagttcagagagtgacatttctaggttttatggcttgctttgggggagaggagttctagtttctattacctgctttggggaaaaggaattctagtttttatggcctgctttgtgggtgaaataggagaaggagaaaggagggcagaagaaggtcagagagaacttcctgcttttgaggccctgccaatccctttcagaagttcaaagtcctcagcctgccaaagcactgtactttggagtatgatgctctgagctgcagtaatggccaaaaagcaggtttggatgtgatagtggatggaaaattcagaagccaggacatcaagggtagggggaatcttgctaaactgacataataggattcctgctgagggcaggctagggtgatcagatattaaggatgggaggattccctgtaaacttaggagcattcttgctgaaacttggctacgcaggcttcccacagatggtggtttgctcggaggcaaggttgaggcattgtcaggaagagggcttaggggagcctaatgaaagtttggtcaaggaaagcgtcttgtcatcttcattcattcttcaaaacagacatgagatacagctgctacaaaacaacaccgattaatagttgtattttatgtgctgcccattaaagtacttacatttttatttttccagaaattttaactacatgcttcagtgttattagattacccttggaaacactcagctacagcaagtgttttgtgctgtttattttagaattcatgggacagctcactttctagccattaatttgagctttcaaagacaagttacacaagtgacaatggggaatttgatctatttgtgtatgtaattatgagttcaacaggcattgttttcaggtactgtgatagaccctttctcttacttaaagcatgtgatttggttcaaaagacatttatgatgttaattttataaaaaatcaagaaggtgatatgagttcccatactgttggcatctgagcttggatgacatgttaacgataacagttagtctagatgaaattcattctagaaataatacaccttgtgagttagaagcaaccttgaagtgcatgtaatcaaaatcccctattttactgactgagaggcaagagaggtcacattgctacttggtgactctttctgtcaagttagagcatcaaaagcaatttacttgaactacagtggattaactctccaaagaaattacctttgttcaaatatgattcaataaaatgcctttaacctttattcagagctgctgcattttttcaggatgaagagtcaaacctgatgtctttttgtatgaagatccacaggaaaaaaattcttttgcaatttaatgccagaaaaaaaaacaaaacaagcagaaactacatctcttgtgaataattggcaggctttcttttgacaacatgagacccatgaggttcattgtgtttctctttttcactttgtgtccaggacctgcggagttagatgacaaaggctaaggaaattttctccctttttactctatgctgtttcttgtttcccatttaacttttctctgtgcttttgtatgtaaatttttattgcaagccaccccacaaatgctttttgaaagctaataaactataaattattcaggaataaatattaagtgacaaagacaaaactctaatccagatcttctatctcccagtgtaaatttcaatccattctatcatgattggaaaggcattaatatctctgacaattcctttctcaatagaaaaaaatgtttccaatatttgtgcaaaagggagatataaaagaggtgtcttattccctctataactttggctcaaattttaaaacttaagaattgcacccctcaaccactgaaccaaaaaaaaaaaaaaagagatagaaaataaaataaaaggaaaagaagaaaagaaaatctttctttttgtttggttgctttggaaatttggaagtatattattttattggcactcagagctgtgcagagtcctgatggaaatgtctatatagtcacagtgaagcctggaacaggcttgggtatccttttgaatacagattatatgtacaaagaccaatgcaatagaaaccttttaaatcaagcttttcctctgtaacaaaagtgtctagtctcttgattcctgaatccattaatgccctttgagtgtcacccagttacatactgctgggcatcaggttgcctttccagtgtggaagcctgagactcctgcacaaaggaactcttagggctcttgatgtttctcatcttgtgacactgaattacagggcttctcttttattgaagtgctgactggaagaagggttatcacagcagccccagccagtgtggcacagctgcccacactctttgtaatgttctttgaaaagaatgtattaataatgtccaaagttgggtcaggctgtcagtcacagaaataattactcttgagaggttaagattcactttcttaaaatcaagtgggagtcatggtagatattagaagaatggagcaaagcacactttaatataactatcaatgtgccaacaatagacatttgggggaggaactgggaatatcatacttacaggaagcatgtctgatgagaactcagagagtggaaaatacaagtatgggatattattttggatttctagctattacatatcatctttcctttttcatcattattattattgcagactaaaaccaaatattattatttattaatccttcagaaatcactttggagcctgcataagagtacatactccagagtctgactgaccatgttcaaatcctggttttgtgacatagctcctgggctaccctgggcaatttacctaaactggctttgccctacctgttatgcaaaatgggggtaataatagtgcctattatatagggttgttgtgaggattaatcgagttaatatttgtaatggcctagaattctgcctggcatagagtcagccttatctgagttgtcattattatttttacaaatgtatcctatctactcaggtgacaaattatttttatttcaacattattctctcatttatatacataaaactactataaattttactattctatagtcagttgaacatcttatttaacaaacatttaaacaagtgtttaaaaatgtattctttgctggacacagtggcacacacctggaatctcagcactttgggaggctaaggcaggaggattcctctaggccaggagtttgagaccagcctgggcaacacagcaagatcccatgccttcaaaaaaattttttaattaactgggcatggtgacacatgcctgtagtcccagctactcaggagcctaaggtgggagaatttcttgagtccaggagtttgaggctacagtaagctctgattgcgccactgcactccaggatgcatgacagatcaagtctctatctcttaaaaaaaaagtatacttagtgttctgtttatagaaacttttgaatttgaaagtgagtataaaattgctgtagtatagagatcacattttgattctttatggatgaataaggttgttatatggtcaatgtataattagtatccaagtgaaacttaacattttaaaagttaatgttattaacattagagaattatgcaaatagaagacaagaaagcaaactggaaaaggcatttcatcttgacatgaaagtttggattggttgttgagattcagaaatccctttgacagccaggctggggggtggagggttattgtggcttctggggcaacacagtgctggagctggactttgatggactcatctgaaacacaaataaagaaatcacttctttaaaataagtttaaaagaacattaaatgtcaggtagcccaacctctatgacttctatttagaatagttgatgtaaatgggaaatataatgtacataagtgcattatgtaattatgtacatatattatacataagtgcatagtgcatactacatttccagatgtctatgttttgaattattgttatcacaacaatattcatgtttgtgatatttcaaagctctatatacagggaggagagtgattaaaagcattttaaaatgtgaacactagattacccttatttagctagatagcttaatatttttacgtaggtattcaatagaaaatggtacattatattttctctcctcactacaatagtgtatgtagaaaagcatactacaacagtgtatgtagaaaagcataccctattgcttttctttatgagttggcagtgggaagggtgaactgtgatttagcaagtactttatacttctaattgctatgttttttatcctgcaacccagttgcctatggatattgactgctgtcagtactccagtttgctacacactagtaagccactgataaaactaagaaatttagagtcttttgtagttccatatgaattttaaatttttttctttctgtgtctgtgaagaatgtcatgggtattttgatagggattgcattaaattgttagataactttgagtagcttggaaattttaacaatattaatttttccagtacaatccaatatatttttatttatttgtgtctttctcattttctttcatcagtgttttatggtattcattgtagagatcttttacgtcttcgattaagtttattcctagttgttttattttattttttggtagctattggaaatgggattgctttcttgatttcattttcagatattttgctattggtgtatagaaactctactggttattgtttgttgactttgtatcctggaactttaccacatttatttattaattaaaacggttttttggtggtggccatggtgacacagccaccaaaatatgtacatgtgggtatatatatacacacacacacacacatatacacgcacatatacacacatatatatgtatatatacacacatatatacacatatatgtatatatacacacatatacacatatatgtatatatacacatatatgtatatatacacacatatacacatatatgtatatatacacatatatacacatatatgtatatatacacacatatgtatatatacacatatatacacatatatgtatatatacacacatatatacacatatatacacatatatgtatatatacacacatatatacacatatatgtatatatacacatatatacacatatatgtatatacacacatatatacacatatatgtatatacacacatatatatacacatatatgtatatatacacatatatacatatgtatacctggaatatatataccagactatatataatcaggtcatctgcaaacagggacagcttgacttctttctttccaaatggggatatcctatactttacttcttttgcctaatttttcagctagaacttccattactgtgttgaagaaaaataaaacagtatgtgtgtgtgtgtatgtgtgtatgttttcctgcatacatacacaatggaataccattcagccatgaaacagaatgaaatcctgtcatttgcggcaacatagatgaaactagagaacattatgtaagtgaagcaagccaggcacagaaagacaaacatcatataacctcactcttgtgtggagtataaagaagttgatcacatagaagtagacagtagaatagttgttaccagaggcaggggaggagagagtggagaggaaggtggggagaggttagtaaacacgtgaaacgttatggttagccaggaagaatatgttcaggtgttctattacccagtagggtcaatgtaactaaagtaacatatatttcaagatagctgaaaaagaggattttgaatgctattgccacaaagaaatgataaatgtttaaagtgatcgatgtgtcaattacccctatttgaacattttactgtgtattcatgtattgaaacatcacactgtaacctataaatatgtacacttatgatgccaattataagtaaaagaaaaatttttaaaaatccaggaaatttggaattgtgaactgtaccatattagccaataaattataagatttcaatgatttgtagaccttatgcagctattaaactagcaaatcctattttttgcattaaaatgatcttggaaataatttatcacatgtatattttaagagctttgagatcatatacatgcagaagaaatgagcccagtgtgaaggggctgactggccctcctatattttgaaggtctggaagtggcacaacatggatattactgagtctaccaaagcctttactttcagacatcatgggagttgtgttctaggtgccactagaaaggttgacctgagtccagttattctacattagtaattcaccacagaaccatcagggttactgcaaactataagagttagattgaattttctgagatttatggaaaagacagggtacaataatttagtgactatcacaaggtacttggaatgggtacattaactgctaagtagcctactcgaggagcaaatgaatgacataacatccccactttacctttcatttattatggccaatctgaaaatcctaatgacaagcgacattttaaacaggagaactgaggacatttagaatagtgaataaaggtttggtggcatacatgtctgaagagccaacacaaagatcttcctgtggacagatagttacaagtgatgctttcccatacaaactgtaagttggttctggagggtgtagtagtaacaggattttaatgtgaaggcatctactgtaagttcagtttactaaaagcagagagtccttggcttatctatgtgctgcataacttaaaattacacttctatgaatgaagataggagctttgcttgaatttattctatccaaagagaacaatgtattggtggttgtgggaaccttgggagctcatcatgctatcaacataaaagttgcagtagagagaaaaaggagttgttgggcatctccagatatgagtcttgcctttaaagaaaaagatatcagaatatcttaaaataagaagatttatttccatgttcaaagattctaaagagattatctaagaattgatagaagagtttcaaaggcgtatcttgactatacaattacaaattaccttaaggaagatcaaaaagtagacatttccatggaaatattagtaggtttttaataaatccaacttttgaaaggaaaacacataaaatatcaaaggaaaatgcataactaaacaaggattaaaaaatatgaataaacatgtaagaataatgccagacaaagtgtaggatgggatgattttttgaaaaaatgttaaaaaatttaagaagtatttttgcaaagctagttagagcaaaactaacaaggaagatatgataggctcattctggagtagataagtatgaggttgcaaaatgacaacgggaaagcaagagctactcattcttcatttcttccattctatcctagccaaagaatacactttcagttcaaggaagagattcttcattaatcagataggggatcagagagtgagaaaacacatagcatttaaataaatcaagtctcagaagaattgtcaggccttaaatgaacttgaagatattattttagactaactgtcggtattttttattgtttttttattgttttatttattatcagtattttattgttcataaatatgctaggctgccatccatctgcagccttgatcctaatttccaacatttaggaaaaggtgaatttaagcagctatcaattattatgtgtattagtctccagcaaaggactaataaatagaggacataagaaatacttggaaaagaatatagtgatcactagaaagcctcatgagttcactaagaataaattattcgacttaaactatttggtctgttttgaaggaatactaatccaggaagcatgtttatatttgtagatgacataattttttaggcattgtagataaatttaaaaacgttaacaaatttgaaaagaaaagtctgttggcttgcatgatggaaaagacagacaagatgatatactttgttagaaatcaacctccaaagcatggaatagcaaaatacatgtgtaacaacattaaggtaaaaacaggcagaggtttcagttgctcacagtttttatgagacccagttgtgttttctggcttctaaagtatctaacacaaatcttaggctgctcaatgggactatctagctgctattagcagaagctctccactgagcagttctcatctggagtaatttggcttactctgggctgtgaattttaagatgaaccctaataaacaagaatgtcctcacctgagatgagtgaaaactatgttgtataagaaactgttgaaaccattggagatactagtttggaaggaatctcacgtgatgactatttttaaatataagaaaaataatatcatttacacatttctcatccaaaatattgaactaagaaatacgagccaaagcctgcctgtcctactcaacaaaggcaagtaatgtcttgctcgtgcctgactttcagaaaattcctctgtgttttcagattttcactttaggttagcagaaatgatggtcccttctgcttaagtggctgtgtaacccttgagcaggtcattacacaaacataccctgacttggaatatgcaatcctagtattaatagttatcatttaaaaataactccatatggacaaaggaaaagcctgagtatttcatgagcctcattagttcttgggactattgcacatcatcatgcatcttctgccatacttaattgtgcaacgaaatttgtggcacagttgcttggagggtccaggtgttttcatgtggaagtgcagcaaggggattctttaatatttaatccctctagggaggattagagcaagctgccttgttttagagggactgggagtctggcatgctgaaattagaggcgggaattgattcaggaaagtttaagcctgggttgaagcaaaaacctaactatacaggtaaaggttagaactagatataggtgttagagatgacagattgtgatttgttcaactattagtaatttgtatacatttagtgaataaaactggctttaaatagaaggtttaggtaaagttgaagaaaatataaaactttaggaaaagtgtaattggagaagcagaggttgaaatttgctgtgggtacagacagtaaagcatatgcacgtggtacaggcctgggtcccagcacacacagaacactagtcggggtccatctggaaagaataagcaggccaggctcagtagctaggctattaaagtccgtgaaatccttgttaggatgagttgaagggaaagtagcctctcaggcttgtgccaaccagaagacaaagtttgaattcttcccagtctcaaagagtgaaggtagatatatcagaccttctccaggtgaagccttgtttcatctcttcctcctgctcctcccaggacctgaagagacacatctacaactttcttactcctttcaggtttggatttgtgttctagcaaggggtccacttgtcttgacaaattactgtttacgtttaatttcatgtgatccaagatatgttgccttatgaaactcttgtgcatagctgatgggaatgtaaaatggtgcagccactgtgaaaagctgtatggcagttcttcaaaacatttgacagaattacagtatgatctgacaattccatttacaggttatatatgcaaaagagttgggactcaaacagatattttcacaaccaagtgcatagcagcattattcacaatagccaaaaggtggaaatcatccaaaagtccattgaaagacaaatggatcaacaaaatgtggtacacacctaacaatggaatattatccacccttaaaaaggaatgtaatttcaatacatgcaacaacatgcatgaaccttgaaaacattatactaaatgaaataagccagacacaaaaagtcaaacagcatatgattcgagttatatgaggtacctagagtaatcaaattggtagagacaaaaagagtggtggttactgggggctggggacaggggtgaatgggaagttattgttaatggatagagttacagcgtgggacgatgatgaaaagttctggggaccaacggtggtgatggctgcagaacaatgtgaatgtacttaatggcactgaaatgtacactaataaatggttaaagtgttaaattttatgttatgtatattttaatcatcaaaaaattaaaatatattgccttagagagtaatgagctttttaatttttatttatttatttatttgagacagagtctcactctgttgcctaggatggagggcagtggcgcaatcttggctcacagcaacctctgcctcccgggttcaagcgattctcatgcctcagcttccagagtagctgtgattacaggcactgccaccatgcccggctaatttttatatttttaatagatatagggtttcaccatgttggacaggctggtctcgaactcctgacctcaagtgatccacccacttcggcctcccaaagtgctgggattacaggcatgagccaccgtgcccagccgagtaatgagcttttcaccactgacagtgatcaagcagagcaatcagacagaagtatataaaaacagatataaaattaaaatgtaaatagtatatataataaatgtataaatatataatatatattaacatatatactataaaaagttatgtaaatgttagaatagataatatagtcatccctctgttccctggggattgattccaggatgtctacagatatcaaaatccgagggtgctaagtttcttgtataaaatgggagagtatttgtaaatagcctcctcacattctctcacatactgtttaatcatctctaggttatttataatacctaacacaatataaatgctatgaaaagttgttacatatatttgtatttgtattatttttattgttgtattataattgtttactcttacttttcctcggaatatttttgatcttcatttggttgaattcacagatgtggaacctgtagatacggaggcctgactgtttatattataatatataaaataaatatacatataaatatataaacatttaaatacacaacatatatcatatataataagaatacatatgtatatttgtggttatttgtctttaaagcatcttgtagtttgtgcaaattggacaaattataacttcactacacctcaggtattttgtttatgaaatataaatcagttcctacattgaaaagatgttataacaaccaaatagcatcataatatgaaattgaccagtttttgtggtttatcaaatgtccattaaatgttaatttctattggactgaacataatgaaaattacctttcagttttctggaatttatgattgtaagaggaggtagcatcaccaaaaagtaatgacagattgattttgagatgctatgcaggcatcctgggcaactgtggaagaagaagcaggtttacagaagttatgttccaggatggagacagaggtgttcctcctggtcagggtccccatgtgtatggatgaacactatggatgaagctcgtgggctggtcaaacaccaagtatgaactggcaacactaaccaggcagggaaatgggttgaaactaaaggatcagctacaaattggagagaggacatattaggaagagatagttatgttattagcccaaattagacttaggagagcaggaagggatgtttagggaaatcaggcaaggaagaggacagaggtgctgagacacttctgtcgacctgactccttcccattgctgagcttcagctcaggcttagccctcctcgcctgtgacctctcatccctcagcactctgatcaagatctccttgctgaagctcctgagagaagtgacaactctcttctgcatctgacacacctttctctcttagcacatggaccattttattcactcatgctgattccaatattagacttgaagtgctttgaaagaagaagcaacattttctttgcctccttgggagttatggagccaatgaatcaaataaaaacatgcacagacaagaaggctctgcaatgcatgagccagtcagaggctctggaggattctttgagggaaaagaagctgagcatcgtcttctaaaatagccttctccccgcaacattaaagataactggcatttgatctacatcttggagagtcagatagaaaaggttgctttttatctcttgaaattactttatctcacattgtttgaaccttaactgaactgctaaccaccatgaggacactgtacatcatgttataattacaggtgagcatgcgtgtctcccgtcttctcggcaaattctccaggtccacagagagaccattcatctttgtggaacacccactactttcttacctaggcagtgattggaagaaatattaggtaccacattagtattttggagtgaatgaattaatgatataaattctcaggacattcaggcagactgatgacttcaggggtctgtactaataggaagaacaagagtccatctgccttcttgttacttgatcagtaataaaatcaaaccaacagtctgcactcccagatgttgtgtaggctgtgtctttaagttaaaaaactacaaagcctcagtgtgccacccagtgcctagtaggcctgtgccatcagtgtagaagactgtgctatagagatctgtgacaagggttagtcatgcagtggtacatatacccaggtgaaccttggcctgttttacaaaaaaataaaaaaataagccaactctaagacagggttagtttaagtgtagtttaatagttcctatgtacattcttagtaagaaatgttagcccagggattttaatgcaattagaacttaaattctatttctgcaaagaaatgagtttttattaacattactgatgtgaaatgatttcagaaatccccaggctgccaacactgaaatttgatccatagccttgattctcctcactttgcatacttgtatttattcattcattattcatctattcattcattaagctattagtcacaaatatttgttaatgtatgaatggtatattatctgttttttaaggaaattaaaactatgagatatagcactagattatagcctcgcctatttcactgggcattttaggaaggcagtaattgataatgtgtcattaatttttatgtgataatgtctattgcagttcctggcacatagtaggaactccataaatacttactaataaataaataaatttcctacccttatagagaattttttgtcaaatgtgagtaactaatttttcttatcccatatggagaataacttttttgtgactaatattattgggattgaaacagacacaaagacaaaatttataatataaaatagataaattgatttaagatttcacaggcatgatgttaatgaacatttcagatgctgggagaaatttcaaaactaaagctacattttaatggctccttaaaagaagcgagtgtgcataagggatttgtgaggagaagggttgattatagctcaatctgagatgtttaagagtggatctttaactgaatagaagagattgtgttttgaaaatggaaagcatacaggttatttttgttttaggaaggagacaccatgaatatctcaaagctttagagaagtgaaattcttttagaaaaacaacgttgtgattaaacaataaaaacaaaatataagcaccattcttgccatggtttttgttatttctaatacaaattatatgtaatcatcaagctggaaagggcactaaagatcttttagcctaccttctttttttaggtgagtaaactggagaatatagagatttttcaagaactgggaagggtctgagattttaggctatttgcaaactaactagttagcttgtcacggtttcatgaatgctggtagaaaatgcaagactcctggataagaggtgaaagacagtttcttttttctttctttcttttttcttttttgagacggagtctctgtcatgcaggctggagtgcagtggcgcgatctcggctcactgcaacctctggttcccaggttcaagtgattctcctgcctcagcctcctgagtagctgggactacaggcatgtgccactgtgcccggctaattcttgtatttttagtagcaaagggtttcaccatgttggccaggctggtcttgaactcctgacctcaggtgatcaacctgcctcggccttccaaagtgctgggattacagacgtgagccaccgcgccaggccgacagtttcttatacacggaatgacaataaccaatgtatcagcatctgtatatccaatccttaagccccatttcccacaggggacataaagaaggctccctgatacatgtacaggcagagctgcatggcaggaggagagccctgcacttaggacccaggaccttttccaatgggtagaaggcaagtcggccctttctcctggagggtgatttatctttattacactagagagtaagcaagctatcccttttctctagagggtgatactgcctctatcttctcaggctgtttgctttccaaacaccttcaaaaactttatccagaacacagggcagtcagcacttcactgtcaagatgcacagaaatgtgagagattcatagagaattatttttcagcagggatgagtcacttgtagaagaccacacagttgtcttcaagctgagggttcttttcacatcattatgctgtttccccataaatacctgaagccacatcagcattttcatgatgcgtagattcctattttctggaaatttgttttttccattggagaggcaaactttgaaatcttcataataagattcatgaagtcaagacagtttatgctgtttctaaatatccaggttgttttactgcctcccttgcttctgggatcagcattggcatcccagttttaccttggatagaatgtggcctggcattgcttaggctgatggaggcagtggaggtagttaagaaggagatggaaccaaatgtccagtaagtctgaatacaaggtaactcagcatcacagatgattttcctgttttctcaatttttctaatatttgtcaccagtctaaatgtacaaagtcttagggatgtagatgaaattctgtggcttacttacaacacttaatttatgactttaattacccatacatacttcaatcacatatgcaattatatggtatgttagtgaaattgctctttctcccgtctcctgaaaaagtgttactcaaattctacacatgcatttgcgacatttagagccattttggggccatctgacgtggttttccaggaccatcatttctacattcatattaagtttatttttaatacagcagctgttgtttctgtgcataaattttatcttaaatataaatatattagaaagctttgtttttacatctgtgttgtgaatatttcatgatctctaaaaattaacaatgtagtttgtggcttttaaagacaatatttaaaaaccttgtgaatagtaacttccaacggtggcaggtataagggcataaccctagcgagtaatcctaaatccaggtcacatttctttgccccactttctatcaactcatttaactgagctccagagcatctcaactagaattagcttagggcatttcaagataatgcagcttcttcaaaagaaagggtcctggaccataagtcacttcctaagaacttgaatatagaaaaattccctttttactaagagatgatcctcacctgattatgcatgtgatattagcttaccttaactaagtaatttacaattctaatcccattttttctcatcaaaataggaaaaatgtatatactgctggtgtctgagagtagttatgagtgttagataaaataatgaatatgaaaatctacaaaccataacttacatttgtttatgtatttgtttatgatgttcctcccctgtcattctctatcttgattgttggcacccatatccacccaggcacctaaatttcaaacctggaaagagtctttgatttactccccctataaaccattatcaagtcctgccaaatttttaccttagtatatcctcgtctttatggtcctcttatcctaactattgccttgttctggctttaattcattgtgtcttggcaggctctatgatcacctgagagcctctttttcacacagccttcagagtaatcgacataaaggtgaatcaaattgtgtcactcttaaaattaaaatcttccagtggttgacatttgcctaaacacacccaaagtgcattcagtaattccaagttctataaagaaatctcctcttaataagtaattccaggccaggcacggtggctcatgcctgtaatcccagcattttgggaggccgagacaggtggattgcttggagcccaggagttcgagaccagcctaggcaacatggcgaaaccatctctacaaaaattagctgggcatgatggctctcacctgtagtcccagctacttaggaggctgaggtgggagaattgcttgagactggcaggttgaggctgcagtaaactgaaatcatgccactatactccagcctgggcaacagagtgagaccctatctcaaaaataaaaaacaaacaaacaaacaaaaaaggcattccaggaccaggtgcagtggctcacacctataatcccaatgatttgggaaactgaggccaggagtttgagaacagcctgggcaacatattgggaccctgtcccctgtctctacaaaaagtaaaataaaaagattagccagatgtggtggtgtatacatgtaatcgtagctacttggcaggctgaggcaggaggactacttgagcccaagagtttgaggctacagagagatggtgccagcgcactccagcctgggcaacagagcaagattcttcctgtcttcacaaggaagaaaagcattccataatagaaataattagaaattctgtgtaatcgaaatttttattgctgaaaaactcttatttgcatagtaaggccttataggagtcctagaataaaggcatctctttgtttccccaaaaatgtgatattcctaaatgaaattttttttgtttggcaaaacatctgttattgctctgagaaaggcacacatcaaaacgcaagcccataaaataaagcccaaactcctaaacatggtccagaggcttcctttcatgacctcgacctgcctgtttctctctctgcctttgacctctcctgagcccccaaccccaagtgctcgtaactgttagcagagtttgcaagaaaaagagagatatgttggatgtcctccaaaattgaggtgtagtctacactcttaaaattgtagtaagttgtaatatttattagttataatttatatttaaaattgtttttagatgataacatatcaccttatctttctctttgacacatgtagatgtcatcaggctatttgttctttggaggtagcacatacattttaaaggactaaattcaacaccaagattgaaattttggttgatattttaagagtcagtatattggcataccatacagattcatatcatggagataacagatgggaaagcggcataaggtatgcctaatttatcaaacctaggtagtgttcatatctcaggcatgcatatggaggaaaggcctgaattatgtcactgatagttttaccaagaagtacttacatttatgagattgagagttgaagctaattaatgatcttatacctttttttttttttttttttagtactcaaaagatccaaagttagtagtttgataattaggctgtacttcattttcagacagaaattagacatgattaggaatgctgaagcactgggcaggtcagttgctcatcattattaaagccatttaatgcattttaatggtggttgataaggtacaaaatgctacgtaagccaaatgaaaaagttttattccattatatgttaagcgtagatataaatgagttcccatttgcattttttatgcattagttcaaaaaattaaacatttctttcttatatatgagtaatagaatgtgtaatttgtaagagatgggcactgctgaagccagcacctcttcacactgtgcacctcaggattctcagacacaaattgttatgtaatagaaaattaaggaaaagatcttttcagcatttgtgtggctgaagaatcgtgctttaagctctaagaccaattgcttgtgtaagtggctcacatttattaataatataaaatgataatctaggtctactgtcttatttatgctaggcttacagactttgttaatttatagaggtaaacaaacaacaaaagagatagtgcatagtatagtttctggtgaatattctattttgttagccatgttttgaaaatattctatggccgggcgcggtggctcacgcctgtaatcccagcactttgggaggccaaggtgggtggatcacgaggtcaggagattgagaccatcctggctaacacggtgaaaccctgtctctactaaaaaaaatacaaaaaattagctgggcgtggtggcgggcgcctgtattcccagctacttggaggctgaggcaggagaatagtgtgaacccgggaagcggagcttgcagtgagcggagatgtgccactgcactccagcctgggtgacagagcgagactccgtatcaaaatatatatattactagttcccatctactttagagcaattcttatattttaaaattatttttcataaataacttagtgttgggatttgaggataccaataaataccatcctttttatgtacctggtttagaaaccattgagacacagttacagacagatggagatcaaaatattccttttgttaactgataaggagctattggggcttgtagcttatatgtgatgtcaggtcaagtggatctactaacacgttctgatacacaggctaacctgaggatcagtacttgggagggaggtttgaacctgcagagcagagagacttcctcaggatcgctgcctcgctttggtccaagggaagaggacagatagagaccatgtctcccatgctccactcacatgagaggaccaatggctgtcatccaccaacagatagctcattccactactatgaagagtactaagaattagacaagagccagaacaggtcttttgttggaagccagagtaatagcagcaagcaccttttatgcttcctaaacctcctgatgtggacaacacatgtagtttatggtagggctacacagacagcacactaattgatgatgccactgccttgtattgtcttaagggaggcaatgggaaacatagtatgtctttattctatttcttgtgtaaaaagtagatggaaatggatgggaacatccttggttgaggggacagaggttgatttcaaggctcttattacataaacggtaaaagaggagaggtcctggtgttaagctcatcagcgtccagcaacctcagccacaatgtgtgtctctgacctactcagggctgtccacatcagaaaactggagcataagacagtctctctccaaatgctcttgtcttggaggtgttcccaggcttcaccccatgcagccacccaaagggagagactgccaggaaggcggggaggaggcatctgtcctgattattgagtcaccaggtagctattagtggtcatccctggttcttcctgtgactgtgtgcacattacatggaatctccaagtggatgggctggttactgattgagactcctaagaagattgtgtctaaatccctgattatgtcatatcaaagcaaatggtatcaggatataaccaggaaggtttgttaaaggtgaaatcactgtttcataacagcttttgaaggcataagaaagccaaaatagttgataaatctcatggtgattctggacaagcaaggatcttcactgtcctcttaatgaagtgtaatgcaagtagctaacatgtttagaatgtgccaggcagtgttctaatagcctaacatgaattaatgaatttaaagtaaattagttcattttaagtctcagaaaagcccatttgggatgattactactattattctgttgttttgaggtggacagttctgtagatacctgtcaggtctgcttgattcagagtcgagttcaggtcctgaatatctttgttaattttctgtctcaatgatctgactaatattgtcagtggggtgttaaagtctcccactattattgtgtgggagtctgagtctctttgacaatctctaagaacttgctttatgaatctgggtgcccctgtattgggtgcatatatatttagggtagttagctctcttgttgaattgaaccctttcccattatgtaatgaccttctttgtcttttttaatctttgttggtttaaagcctgttttgtcagaaactgggttttgttttatcttcctattatgaaagagggaatgaggttcttagagggctaaatagcctactgacattccccagctaaaaaaaaaaaaaaaaaaaaatggcagaaggacaagagccatctctacagctggagcaccaaacccccgcatcacactgcttatcaccaacgcagtagaatcactggtgattcctactaagctgagtccaattctagaaaaaaatctgtgacttgtgtttgtttatttagttttaaaggaaatacaactaataacatttattaaaagcaatttttagtgttggatttgatttcagcaacattttagcaaatgctcatttctatatgacctgatcttatgtttatggatgatttgttttgctttgcctttgaagtttatatttgaagtgctaccaaatttatttagttgtttacttctttgtgtgttggtatttccttccttccactaatagcgtaagctctgtgaaagaagtgctcagcaatagtaggaattttttaagtgtttgtagaatgattaaaagaatgaatgaatgaagttaaaaagttaattgtttatttagcttatagtgacctggtatctttataaacatagtctacatagtcttaaatggagaactactgttaataactcaattgttttagaaagatgagacaaatgaattatttaaaatccttgcaggtctatgattttgttaaacgaaatgtacttaatgactcatattcttcatataagtgtgtggttaatgattcatatttttaacacaagtatgtacttatttatttttaattgatgtaaaatgaaatgatcagtgaagagttgtgtttaaaaatattttccttacaattcccaacagctttaataataagcagtctcatgcttgtttgtttttaactccagactttgtatatatgatttcctctccctataatgctcaatgcattccccttcatcttattagctcctttttatcatttagatattagcttccacatcttttcctccaggaaacatttctaggcccttcaagttgggccaagtgtacattctctgctacctctctggctgccttcataatgcagtgtagcttactggtcttactggatggtttccccaaacccatattgttctcgatgttaagactctctttagcacctagtacaggagcagacagagaaaaacataaatattgaatgagttgagtgaataaatgaatgagcatcaataactaagaaagtgggcatgctataagaattattctcaagtaacagtaaatgagtttgtaaaacagaataggagccccaggcaggaatcagagggacacatttagactgccctgcatagctcaaatggtcataatggtttcaggcattttgaaagctgggcatgtatcatcagctcatgccacgtaatttccaaccttctatgccaatcccagaagcaaggagaatgaacataaaaccagggaaaatgaataagaaacacttggtgaggaaacagcaactgcaggaagggcacagtgagccaaatgtaaggacagtttcccaggtgggtggagaaacccatgagacattggaaactgtaagagaagcaggcaagagaaactgcagaacccaagagaaactgcacagtacaccaacagcagcaaaagtgaaggacaccacaaggtagtgataccacaaggataaaggaatagtggaggagagcaagatagtattgctaaaagaaaaacttcagccgaattaaattcaaaggactttaattgagcaatgaaggattcaaaaatcaggcagcccccagaatcacagcagattcagagagactccaaggatgcctcatggtcagaacaaatttatagacaaagaaagtaaagtgagatatagaaatcggaagtgaggtacagaaacagctggattggttatagctcgggtttgccttatttgaacgcagtttgaacactcagcagtgtgtgactggttgaaatatggctgctgggattggccaagactcccgagattaaggtaatgttacaggcgtacactcctaaattaggttttcagtcttgtctacctattaagttaggttgcagttcatccacaaggactcaaatatagaagtatggagttcttctcagtccatacttaagtttgctgtaacagtatgactagtattatgtgcagagggcaatacagctctaagagaaacagttataattgagctctgttctgctgcagtcaatagaagtttcctctgacacatacttggtaacgctgttacccttcgtttgcctttgtgcatacctaagacatcttccaggacttttgattctcttgataatgagtcagcatgatgatgggccagggtcttgtaaggagagctcactttttggaatggatcttcctctagctttgttattctcagctcagatttcatcctgcctgagcccttatagtagaacagtaggtagctacctaacaacgtctgagaccctggacattccgcctttctcctcaacacacagttctttaatgctaccctgatagctgttttcttcaaggacttaggtgaagctgcagactgtctcatcaaatgagtgtgtcatcagctctctgacaacatattgtagagtgcttctcaaatgttaatgatcattattggggtcgataaaatatattattcaaaaattacaatacaaaaaaagtatgttacaagtgccttaaattgtcagagaaaggagaaataatttatacttggagtgactaaacaaaaactccaaggggattagatgaaaattatgttgtttctgtccaataagctaccccttgagcaatctaacatttatcataaattctgttggtgaatctgctatctcagtgactagctctatttgaaagaaaaagatagtttctattttcaagcagaaaaatatgaattacttgtctaaagtattaatagaaagatgtttaatcagtccttagtctctttctattgtgcaatacagatgagaaataatttcaaaaacgatgtggaaggatgcagtgtgccatgctagggtgaaatggttacccagaaggcatctcttatttggggttccttctctgtatagatgcttatgtgagcttaaattttttcatgtatgcttttctttaaagcccatcagagtataagaaaaactgaatgtctgttagccatattaatgagtgaatgaatggtttcctgtatgtgttctgttgtaggtccattaaatgaaagcactgaaacaaattagggctttacttaatgtgtatattaattggctcaagcctattaacatacaaaaagttaattagcaagtcaggacttgtagtaatgtcttaaaggtggttgtaaaacttatgtaaaagactttttctccaaaccattccacttctctaacttggaaagtttatgtaattatgaaatctgatcctaaaggatgtagcaaaaccagtggtctttcttactaaatttgttggccctgcacctagcctccaacatttttataatggtgcttctctttcatggagcttcaaaagtcattacaagaaattctactcctttgttcttccctttttaataattaaaaaaatcatctggctgggctgggtggctcaagcctgtaatcccagcactttgggaggccgatgcgggtggatcacaaggtcaggagaccgacattctggctaacaccgtgacaccccatctctactaaaaacacaaaaaattagcagagcctggtggcgggcgcctgtagtaccagctactcctaggctgaggcaggagaatggcgtgaacctgggaggcagagcttgcagatcgcgctactgcactccagcctgtgtgacagagcgagactccactacaaaaaaaaaaaaaaaaaaaaaaatcatctatgggatattttacttccatagtacacttaagtttttcttgcctcaatcaattaaaatatacatttgttaaaaacctttatttgcagagtaattgtccaagctgccctttaggatgaatcagtagagcttaaagatgatttgttacaatattaaatctaacaagcaactgatttgtaattttctaaagatattacggggtgaagaatcaaaatggacagcatctagaaatctgtcaaaatctagatgccttcttattacaacttacttcattttaatattgggaagttagcttaacttcaaaagattttgtctcataatactctattattattagtttgataaatttcaagtatacagaaaagtatagagcaaatatcccaaatacctgtgtgtcttttgccagtttcattctctcctgtcttccacattgcagcatttggtgtttattttttccaataatctcttagtgtttcactctatagttatagactcataaacaatatggtattgtttgcatatttaagctttatttaaatattagtacataaaatttaaatatgtgcagtataacaccattattgctttttctgctgaacataatgtttttgatatttatccatattgttgtatgtagtgctagttcatttactttaacttctatgttgtattctatatagaggaatgaacatttatgttgtttctaatttttattcttataaactcttgccatttatgcatatcatcttgtacacatgctacaagaatttctctaagcttatcggtgtgaaattgctaaatcatagcatttgtgcagatcttcaacttcactaagtctggagctttcagtttgcacttatccctccaggacatagactgcatattgcactgataccaatcagttctttctcactataaaattttttttttaatcttttgagtgtgaagtgatatccagttgttgacttaatttgcatttgtctgattagtgtgagcttgagcatttttgcttatttgctttatgtattttttaaaaattttaagggtaatactggcctcctaaagtaaatttggacgtattccccccgcttgaatttttcaaagtttaagaagaattggtattcgttcatctttaaatgtttcatagaattcagtgctgatgccatctggtgctgtgcttttctttgatgtaaagttctaaattacttattcaatctccttactcactattggtcttttcagactttctatctgttcctaatttagtctcagtaggttgtatgtttctaggaatttactgttttattttaagtcatctagtttgttggagtataattctttacagcagtcttttgtgattctgtttccttttttttttttttttttattgaggtggagtctcactctgtcacccaggctggagtgcagtggtgtgatttcggctcaccacaacctctgcctccagggttcaagcaattctcatgcctcagcatcccgagtagctgggattacaggcatgcaccactgtagttgattaatttttgtatttttagtagagacagggtttcactatgttggccgagctggtctcgaactcctgacctcaagtgatcagctgcctcagcctcccaaagtgctgggattaaaggcgtgagccactacgcccagccgcttctttctatttctgtggtatgttttaatgtctcctttgtcatgtctgagccttctttttattctagttaacctcactaaagtattgtcaattgtcaatttcatttttattttcaaaaaacaactccagttcattgatcttttctattgtttctctagtttctctttatctctgctctgatctttattttttctttcctcgtactaactttggattgagtttgttttttttcttgttccttgaggtataacacttggttgtttatttgagatttttcttcttttttaatgtaggcatttatagctacaaaccgccctctttgaactgcttctgttgtagcctataagttttggtgtgtaatatttccacttttgtttgactcaagatattttttgatttttctttcaatttattttttgactcttggttatttaggagcatgttgtttcatttccacatatttgttaatttttcagatttcctcctgttattgattctcattttgatagcattgtggtcagaaaagatacttgatattatttcagtcttcttaaatttgttaagacatgttttatatcttaacatatgatttatcctggagaatatttcaagtgtgcttcagaacaatgtgtattctgctgctattgaatggaatgttctgtgtgtatctgttagcattaccataataacaaataatgctagcttaccctgataccaaagccaggcaaagacagtgtaagaaaaaaaaaaatagggtgatgtccctgatgaacatagatgcaaaaattctcatcaaaatactagcaaaccaaattcaaaagcacattaaaaacaccatacatcataatcaaatgtgatttattttggggctgcaaggatggttcaatatgtgcaaatcaataaacattatgcattacattaatagaacaaaggacagaaaccaaataaacgtgatcaatagatgcagaaaaatgttataacaaaattcaacattcatttatgataaaaactctcaacaaattagatatgatttagtatgtaaggattgcaccttaccacaataaaggtgcaattttatatgtgataagcctacagctaatatttatgctcaatggtgaaaaactgcaagttttctttttaaatttatgcacaaagcaaggatacccactctcaacactactattcagcataataactggaagtcctaatcagagcagttaggcaagagagagaaataaaagacctccaaattggaaggaaagaagttaaattgtccttctttgcaaatggcacaatcttatatatagaaaaccctacagactctgagaactagtaaatgaattcagtaaagttagaggatatgaagtcagcatacaaaagtcagtagtgtctctacactaatgaggaactatcataaaaagaaagtaagaaaacaatcccattaaaaacagctacaaaaaataaaatacttaggaataaatttaaccaaggaggtaaaagacctgtacactgaaagctcagcaacactatgaaagaacttgatgacacaaataaatggaaagatatcttatgtccatacattggaagaattaatattttttaaatgttcatactccccccaaggagatctacaaattcactacaattgctgtcaaaatcccaatgatattctgtatataaatagaaagaacacttctaaaattcatatggaaccacaaaatacccaaagacaaaaaagaacaaagcttgaaatatcatagtacttgatctcaaaatctattatgaagctataataatccaaaaagaatggtatttcacaataacatatacaacagtagacagaatagagggccaagacataaattcatgcatttacagtcaactgatttttgacaaatgtgttgagaacacacacagaaaggatcatctttttaataaatggtgttggaacacctcaatatccacatgcacgtgaaagttgtcagaatcaaaatgaaggcactggtattaaaaaccaccacaaatacagctagctggggaagggcatgaaggggggcttctccggaacaaatgcctgataacaagaactatcataaaagattctgcaaaaaacaccttgtgcaaaaggccatcacaaccttacacacacacataagtcttgtggacatctgcctatcatctgtttgtccaaactcagactggtatcatacttgttattaatacatgtagtcaaggataattatctcaaaactattatttaattattctcattttttctttaaaaactttttcttgttttttttttttaacttccctgaatatgcacgtggcttactatggcacatgtattcccattgcaatgcctattctaggaagaatattattttcttttagagagtctcccttgcagtttgttatttattgacaaaatggtgtcagaagttaaaccaaagtgagctcacctaggttcaataggtggctcctggaatcatgtaaggtagcaattgagccctttgcactcttcatttccatgagtcaccttttctgtgctggtaaatctcctctcagattcttttacttcttcctttgttgagttctttttaactttattcaagatctgatttggctataaataaggctgccctaaataaaggaccttgtatccgtcttaagactatgaaagttttttctgttgtttttgtggcaagccctttctggtataaagacaaatgtccttctggttaagtactctggtttttacagaatttacattgtgtctatgagggtgtcttttttggtgaattcacttttgattctgcataacaggtttaatatttgtttgatctgcatacctgggttaaaatgtttgtgagtattctgattttggtttcattttggttatgcatgtctgtaaatgatttgactccttttcccttgcatgtttctgaacatttccaagagcaaaaataaacattctaaatggtggacatggaatggccaacagagcagtcatactaccatctacaacacctgttcaaattactgacattccctgagagaatttataggaatgtctttgctcttgagagaataatgagaaatggaattggattcttaaatattaaggcataccaaaactttctctgactcctgatggctacatagattttcctcatgcatgttttcaaatccataaccatcagggggattatttgaactccccccaagtctgttgtttttttttttaagagaattgtaactatacagttaacagatagagccttccaggttctgcctatctcactgtttctttgcctgcctactttgaatctgctgacttttctgctgatgttgagataaacttactgcttatggcattccagccaagatagaaaaaaaaagtcttaaagaactttgagattaatgccttacaaagtacagtagttccatggcaaccaatacctagatttctttttgagatgttaattttggcttgcctaacagttccttagtgtgatgaagcagttagttgaagagttgatattttaaaataaaagagctatttaaatgtttataaaagttaccaaatcaacagtgtcaaattattgaactcagagaaatagtataaagtatctctgtcagcattgaaattgctgtatctgtcacacaaggtctagaaattgctgaagaaaaaaataataacttaaaaaaatgtataatttcttcctggccacattgactacaaaccagaccagcaaacaaaagaataatctgttagtagttcaaggatgcttggacagtttgtttttcttatatgattcagccagtcctacgcgaaatgtaaacatttaaaaatttaactccttaaacttgcttgaagctgaaaaaagaaaatgggggggaacaaaagacaaaaagcattaaaaaatcaaactgctgtggaaattgcatacatgtatatatacacatctatgcacacacacatacacaaacacatgatcatatatgtattcctctagtaatttgtactgaagtaccttgaccatatttattttcataatttggctgttataaacggaaaaatcttcttttcactagtaactggcctagtatctgttcaatattattaaggaatttttatcaagaatgaaacagctagcactacctattgtattaaaattgtaaaacattattattaaatttttaaaattgtaaaacattctgtacatctcaactatgggcaagaatgtggtgttagaaaatcattttctatgactggacttggagcagacccagaagaaatgcagcaggaattctacaaagtccagctaccttagacgtggaattgcttcttttgaaatttaaaaccaatgaaagtagatgcaccaatcaagtctatatgagccttcagttgtaaatgtgtttcatttcaagactgtctgtagtaaatcttagagaacatttttaaacataagcagataaacatggtatatcgtgagtcatagagtaacttaacttacccttctgttgctttattttattaatgattactgggttgatgtcttgccatgtcatcttatcctcaaagtctgtgaaaattatgctcctgttttctgtttaatacccctgcaaagccaagttcagacaacatattttgttgttgttttaaaggcagcctgttttcttatatctctctctccatcttttcacttttcttagtctatctttttttaaacaattttttttcttaattctttcaagaaccatctacatagattatgtttaggtgtttttggaatacaatgaaactagtttttatatgcatagtaagaactttttaaaccttcttgattaaaagacttagttccattttaaaaattgttattctacttcagttattatttcttcctctgagacaatccattggttacctgttttctaccctccagacttatggtccccttgtttcactgtctttagcttttctactgaattctgggagaactttccctgtatccagttccttgattttatgttctgcaatataaattctgcaaggtaaatttttgcctttcaatatggattttaattctgggtttctgttttgtaataatttcatttaataaacttgaattcattctttatttcacgtacctccatttatttaatacactttaaaataattatttaatacactaataaataatttgtacttaatatactttaatgcattctttatttcacatacccctattttattgtatgttgctgtttctagtttcagactattctgctttctgtgaacagtgagaatgctaaggaagtttctaaaactttctttcagttcccatggtaaattattttcagtgctcagccccgcctttatttctgacagagaagtctccatttaccttctttgccaaaggattatcaaaatgccattccattccttttctgttttgcttttttttctatttactatacttgatgatagaaacctgtgtcagagatatatcttagtcctggtttaaacaatgaaaacataatggttttaatactgattagatactgtgagatagagaaagccaaactgattaacttggagatccatcagattttaacaaggaatttataaggactgaaacatgaatcttttgcctttatgtatagggcatttacttaaaaaaagaaaaaaaatgttttaggtcacacacacatatattctttaagtaatatttagtgtttaggtagatactgaagattattaatcttcagtcttatttctctagaaagacttaaaatgtcataaatagatgcaacttgttttctcttaattttgtaagatgagtagaaagttaagtcattattttctctgaattttggtactgatatatttccttttcatgtttctgaaaaaatatatggtattcttcttgaatgagaagaaaactgtcagctaagtgaatacctttagacattcatccatttatctggttgtggagattcgcatcatatattttgtgtcataattaagtagttgaaacaatagatgttatttaactatgggtatacttccttatagttttgatagctataatttaaaatttatatacttgtctatatgccagattcattctaaaattgtattgttctcaattcatttttattttatgtttccttgttttatgaagacagcaagcaattagaatctcataaaatcaaaacttcatgaagtatttacaaaagacaacacacatagaggcacagatagaccactttttataagagtctctatcttttaccttttgattttaaaataaaccttttaacagtcccttctctgtctttttgcaggcatttttaaaaattatattttctattgttggttttcctttagaaaagaaagaacattcttacacctaccagcaggacaagcaaattctgcaaagcaactttgcaaaacacttttaacaattgtagaatttgtatatttcctttgactcaggatgtctaattctagaaagttaacttgagaaaatagtcttgggttattcaaaaatatcactagaaagagaggcattatgtagctatttaaggtagttaagtgccaggatctgtgtgaagtgctacatttcatcccaaatattatccctttttggttcggataaatagaggttactctaaaagactgccaaattttagacacatttcttacaataaaaaacattttatgttgatagctgtaccatcaaatgaataaaatatgtgttataaaatcttcctggccaggtttacttttaagatttctaggctgaaattctactaactttatttgaaatagctgtatgatttcataattgttaagagagttcttagagaaaacatcagaaatcctgactacacaccaatatttttggatacctttattctcactgagagaggagagattatactgatctgttttgctcttatgccttatttatactctgccagtttggaaatttagaacccttccaaaccaaggctttttggagttatttcagatttacagtttaggtctcatgaagatttttatagttgaaataatggatcatttgatgtaaggttgcaaggcaagcaaagcaagtcaaacacttacttaaaagaagattaaagttacacatctattgcactgaagaaaatgagttgccattaattgcagcagtccatcaacaaatgtactttattatcacaaatgtgtgcactgtcacttcaataagctgtaaactgaatcccaataccctctgtagaaattatacttcttggccgggtgcggtggcccatgcctgtaatcctagcactttgggtggctgaggcaggcagatttcctgagctcaggagtttgaaaccaacctgggcaacatggtgaaaccccgtctctactaaaatacaaaaaattagccaggcgtggtggcaggcgcctgtagtcccagctacttgggaggctgaggcaggagaattgcttgaacctgggaggcagaggttgcactgagccaagatctcgccactgcactccagcctgggtgacagagcgagactccatctccaaaaaaaaaaaaaaaaaaaaaaaagagaagacagaagaagaaagaaagaaagagaaagagaaattatacttcttgacttcagaaagacaactaaaatacaactctcaaaatgagaaggtttttagtggctgtctctggagttaagtcatgtttagctagtgctattcactcaaaattccatttaaagtattttctttactagaccatagtagacttctacagagactaagaatattcataagtactggcaattgcagcctaactctagttagcataaattggcaaatgaagttcaaattatgcattggcttctgcaggagtgatgcagtacatcagttacctgagaattcaggagtccaggctaaggaaaatggtttgttagctttaatcaaaataagaagtattttccctcctaagaaggttgcttctatgtttcaactgtgagtgtgaaccatgaaataagagcttcttggtgcaaattgtacattgatacagtcaattctcatggtttacttaaaagcttcacattgtttaactattaaagaaaatcttggcaaattaaacagttctagcagggttaggggaggattgaaagattgaagtaaatctgacaaagcccaaatcaatagaaattcaaacaaatgtgtgttaaaactggctatttaaaccaaactttagtctgtaatgttatagcatattatctacctagtccatttatttggaacacagtggatcttttgaacatatgttactgaacttgggaaaagataatcacaactaaatcctgtatgcacataaaaagagctgcacaactctgtggcaacatttgcacaatttttgcttctttctttgtgtgttgtcaatcattaattatttcattttcaggacttcttatgtgtaaatgctctgttcccctacaccaaattaaataatccacactaccttaatgaaaatgaattatttgaaacaaattgattattctcaatattgaattcaaagtcaaccttacacattttgaattaaccagaccagctttttcactctccagcctctggatcataagcatgccatttaaactcagagatttaaatctgtcacctattaaatgggaccgatgtcatcaggcctatattcttcacatagtgtgaagatcaattatataaggtccatgaatcctatgaagtacagttcaaatgctgtgtatcaatattgataagcactgcaggtttttcctttgaaaacatgtttgaaacccactgatagcacaccctggaaatgagtaaatctgaaccacaggccatgacaatcattcaaggtgctgtgctggagggagagctcagacctgagagtcagagagatctgattaagacatagtttaggctacttagtatccatgagcccacattttatatatttagccgttctgaacttcgattgattttttgattcataagcgtaaatactactattatatttaggactgtcaaatgttaactctaccacctaaattaccaatcggagagacagaagatgacatttcataaggtatattcatatgctcagaacacaacctactgcctggacagattatatgggataaaagaaaaccagttacagaaagaatctttaatgatattaaaatgcttaatttacatgtactcctaaaactctaattgaatatatatgtttaacaataaattctaaggatttgtttttgacaaaatttcagtccacagactttgatgctgctgttctgagtcatttttgtttgcagcagtttcaacatgttcttacctttatattatacttgctcttgttcacttaaggagttcttacttggatttcttactttctgtgaggcactatgttaggtgctgggaagacaaagagaagagatgcaatctctctcctaatggtgctcatatgcagtcactaatgaaaattgttccaataaaatgtaaaatgttgaactgcaattgtattaggagtgaggagcactacgctgagctatgaaaactttcctaccacagagagttcccccagacacagggagcttctctgactttattcctgaatctatgtgctctatgtttgcagatccttcacgcatgggaaacactatggtgtatgaatgggattttaatgactaacacctaatatggaatttaaaatataatactctctgcagaaaggctttccctgatgacctaaatgttctagcttctttccttgccttaatcttgaatttaattcttttcatgaaatgggcccaggccttacttgtacatctccatctattctgacaccagcttatcatctaaatgctgtctctagtctgctagtcttttcaagtactaaaattcccacctttgaaaaacagtttttctgtgatagggactcccaggtgagtccttcttcttagtctacaggtgcttgcacctgtctgggaccactctgcatcttggcctgtctaccttgctctctgtaacattgtaccattttctctaggtactgatctcagttccaactcaagtttcctaatataaagctgtaataactgcctctcaatcttctcctatattcaaatgttcagcctagggattatatcatggggattaaaaatgcaaatatatttacactctattatttaggtaaaagggagttgtttaggccattctaggataatttaaatagtaaatataaaaaaaacttttctctagatattggtaaatttacatataatcgtattctcttatctagaatcaaccctccatggaagataattaagtcacaatagctacttttatactgactttatatatattttgatttttctatatataacacaaaataaccctgtagaaagacctacattgtatgcagataaagcattctaaacttttttcatgaatttcaagaagttcagtgaaaaactttagtacataaacattaagttttgatgagaaggttaatgtaatggaaaattaacaatagactaaaagcacattttactgcctaattcgcatttaattagaactgggttttcatttctgctatgaaaaaaatgttgattgctcaaaattatgcactcttcttttaaaaaaattcttccctctttgtttctttgtatctactacacacacacagagttgcatagtttcatatacataaacacagctttttcctctactctttcttcaaataaaagctccaaaattctcttatttattaagagcttatttaggctcttaaataattaaagtcttatttttcttttaaatggtttgattctcagaaccattttgagtgtaagagcaaaggtgaagtttcagtcattttcaagtatatgaatagcattaatgcactaacacactgttattgcctttgtggagtagaaaataacgaaataatgggctctaagtgtagcatagtgatatggtttggatttctgtccccaaccaaatttcatcttgaattataatcccgtaattcccacaagttgtgggaaggacctggtgggaggtaattaaaacatgggggtggttccccccatgctgttctcatgatagtgagtgagttctcatgagatctgatggttttgtgagtctgtcatttcccctgcttgcacttattctctctcctgccaccctgtggagagctgctttccgccatggttgtaagtttcttgagaccttcccagctatgcagaactatgagtcaattaaacctcttttctttataaattaccctgttttgggtattgcttcatagtgatgtgagaatggactaatacagtaaattgatatcagaaatggggtgttgctataaagatactcaaaatgtggaagtgactttggaactgagtaacaggcagaggttgaaacagtttagagggctcagaagaagacaggaaaatgtagaaaagttgggaacattttagagacttgttgaattgctttgaccaaaatgctgatagtgatatgagaaatgaagtccaggctgaggtggtgtcagtcggaggtgaggaccttgttgggaactggagtaaaggtcactcttgctatgcaaagagactggcagcattttgcctctgccctagagctctgtggagccttgaacttgagagagatgatttagcatatctgacagaagaaatttctaagcagtaaagcattcaagaggtgacagatcataaaagtttgaaaaattttcagcctgacaatgcagtagaaaagacaaacccattttctagggagaaattcaagccagctgcagaaatttgcataagtaataaggagccaaatgctaataccaagactaggggaaaatgtctccagagcatgtcagagagctttgcggcatcacttcccatcacaggcctggaggcctaggagggaaaaatgatttcctgggccagatccagggcacccctgctgtgtgcagtcttgggacttagtgccctgtgtcccagtatagtctaaaaggggccaaggtacagctcaggctattgcttcagggagtgcaagccccaagccttgacaccttccacgtagcgttggtcctgtgggtacacagaagacaagaattgaggttggggaacctccacctagatttcagaggaggtatggaaatgcgtggatatccaggcagaagtctgctgcagggatggagccctcatggagaacctctgctagtgccatgcagaagggaaatgtgagttcagagcccccacacaaagtcccactggggcactgcatagtggaactctgagaagagggccatcatcctccagagcccagaatggtagatctaccaacagtttgcaccttgtgcctggaaaagccccagacactcaatgccagcctgtgaaagcagcctggatgggggctgtaccacacaaagccacagggatggagcttctcaaggctgtgggaacctaccttttgcatcagtgtgacatggttgtgagacttggagtcaaaggagataagtttggaaatttaaggtttaatgacaactctgttggattttggacttacatggggcctgtagcccctttgttttgtccaatttctcccacttgtagtgggtgtatttatccaatacctgtaccccgattgtatctaggaagttactaacttgcttttgattttacaggcttataggcagaagggacttgccttgtctcagatgagactttggacttggaattttgagttaatactggaatgagttaagacttttggggactgttgaaaggacatgattttgttttgatatgtgaggacatgagatttgggaggagccaggggtggaatgatatggtttggcttagtgtccccactcaaatctcatcttgaattgtaatctcatagtccacatgtgttgtgggagacccagtgagaggtaattaaaccatgaggacattttccaccatgctgttctcataagagtgagtgagttctcacaagatctgatggttttatgagtctggcattttccctgcttgtactcattctctcttctgccatcctgtaaagaggtgccttctgctatgactgtaagtttcctgaggcctcccaagctatgcagaactgtgaatcaattcaacctgttttctttgtaaattacccagtctctggtatttcttcatagcagcatgagaacagactaatacacataggaaaaaggagccttcattttttttcaggacagaccttccactagggactcctacatagtttacctcctcaaactgactataaataataggcattcttcacattttcatattacagatgaggatacagaggctcaggcagggctcagcaggtgacagagctggtatatgagtcaaaataaatgtccctgtcatgatatctcatgtctgaggcaattcaatgtatttaaggaaaagtgccttgcaattaaggttgttaaatagtaaaatggattggtaaaggggttggtaactagtactttaacatgtattgtatgttaacattgttaacatgtatttgtttgaaatagcttaggcagacttctgcctaaagaatgaaatatagacaatgtagcctttactacaagctaggatccctgttatgagaagagttttaaattaataaatagtttgcattttcaaaggataaatgaactcattcttatgtctcattaggataactcagacaaccacttggacctctagaatcttttgctataagtctagttgtctctgtccctcatggaatgtcactcttgtatacataatgggctttttcatctctttctcctatcagatgccaatgggaagaaagactaaaacatttcagtgtttttctggctcattagataatccagcaggtgcatgccccactttccagcactagtcttaagcaatcaaggccctaaccaccccaggtactgagcatatatgcctgtgtcagagctttggcagaaatgacagtaaacaaggctgagtgtctctgtgctggtcctaggaatgccttgttgtaggaaagtggtagaaaaggttgtctaaagtttgttagataagcaagctcccatgtcaaccttcgagtttgcaaatttgagtaattactgtttaatattcaagtgcaaataaaacaaaggaaaagctctcaaattactttaaaatgttataaaagctttggtttggcaatctacagctcatactgaaaatgtgggtacttaaagcagatcacaacaggtgaattcaatcaaacattcatgtgtgaaatatgagctcggttgtaagccattctgaagaactattatgccaataaagagaaaatggtaatggattttttttccctgtgaagcacaaatggggactttataatttacttcttatgggttctattgagaaaacccattgtgatgtacttttgggtatccctgctttaaaaaatatcaattacttagttttccaattaaaaacataaattaactatgctttatttcatattacattttccagaatcataaaagtgaataaagtattatttccatactttccaaggctctttatcatttctgaatatgtggattattaatcagtttgctttttccttcccttgtcattgataagttctcctgtagttaaaatttttacctgttttttctttgtatgaagacgttttaaaagactgagaatcagttttcttcaccattcatcaagacatttttatcctttcaatcaaattcaagctaaaattttactcttagcctaaatcgttgattatgcatttaaatcttctttataaagggatgccctttactatattcttctctaccctcgaaagtcaagcttcttatcctttaggtttagaatgtactgtttgactagatggtacttctgatatacatatatatatacatacacacacatatacatatatatattagaacaaggcaattaggtggtgtttagccatataaagccatatatcttttcccaaagcctgccccatagtaggtaatatggccagttttctgaatagtttcattgaatagactcactccagtctaggactctgatagatggagtggagagactttgatctacagacaagactagaactcagttctcctaactactagcttaatgttctttccaatacatgatagttggttaatatcaatgactgtataactctcaataagtttttccctaggcatgaatatcttcttaatatttttaccaacctgcatgtataggctactttttcctttttctaacttctggttaaattccatcaattctaagtttaaaagttctttggttggaggagtcagagtgctggagaatcctccttgctccttctactaaagtaatgccctctgtctttagggactgcacagcattcagatgtgggctagcatgttgttttagtacagcccatccttgagcaacccagggattagggaaactgacaccatgcacagttgaaaatccaagtataaattttgactcttcaaaatcttaactacttatatcctactgttgactggaaggcttatggttaacataaacagtcaattaacaaatttacatgttgtatagtataatatacaattattttgtatacagtaaagtaagttagagaaaacaaaatgttattaagaaaatcataaagaagagaaaatatgtttactattcattaagtgggtcataataaaggtcttcatccttgttatcttcacattgagtgagctgaggaagaggaggcaaagtaagggttggtcttgctgtctcagaggtggcagaggtggaagaggtagaggaagtggaactagaggcaggcataattttacagaaatttgtataattttacagaaatacatgataatttctgtctaactttttgcttttccatttctctaagtatgtttctatattataccaacatttcttccaccactttctttagtccagtaaccatataaaagaagggttcaagtcataaatgaagtaaaagcaatatttaattattggaacccttcttccaatttgtctaatgtcaattcgttttctggcactgcttcttctatgtcttcttcctcattttctggcactggtttggaagctcttatcttcatcaagttgtcttctcctctggtgtggtggctgttagctctttaatttctccgatatctatattttgaaacccttcacgctccaccttttttccatatccaaaatttctttcacagtttccttgattggctctgtcagaaatcctgtgaagtcatgtgcaacatctggacacagctttttctacaataacgatggccactttaatggtgtaatcttcacagactttcacgatgttctttcagggttctcttccatagtgttgacaatcctttccatagtgtaccatgtttaatgagcctcaaaggtccttataatcctctggtctagaggctgaattggagacattgtgtttggggggaagtagaccacttcgatgactttgatattgaactcaaagggttttgggcagccagggacattactcaataccaaaagaactttaaaaggcagtcccctactggcaaagtacttcctcacttcagggacaaagcactgatggaaccaatccagaaaaatgattctcattgtttaggcctttttgtatgaccaaaagactggaagctggtgtttatcttttcccttgaaggcttggagttaacagctttatagataaggggagtcctggtcaccaacccaattgtatttgcaaacaagtggagtagccttttccttcctgcattagatcctggtgctcactgttattccctactaataaatgctctttgtggcttttgtttccagaatagggcacttttgtctgcattaaaaacctgttcaggcagatctttctcctcaatgattatcttaatggcatcttgaaactcatctgctgccttttggtttgaagaacatgcttctcctgttatcttgacagttttttaagccaagtgcttttctaaaattatcaaaccattcttttctggcattaaattctccaactttcggtccttcaccatccttttgctttaagttgtcatctaatgactgttctttttctcaaatcatttacagtctataggtatgactttcttatagcaatcctgcacctacataaaagctaagttttcaatacaagagaatatgtattttgcaaaaagcacaaggttttttcacctgctggtttagctacagtgacaatttcatgaattttctttttttttttttccacagtagaccttgggctggatttatgtatcttgaaatggtgggcaacctcatctgcaatcctgaatctatggtacatatcaagcaattcaactttttcttgtaattttgtaacttttctctgcttcttggaaggactttcagcgtcactcatggcactttgtatggattccatggtgctattcaaggtttacagtattgcagtaaatatgatgaaaaatatgcaaaactatgggacatcactttttactgtgatacactatttgctgaggagatgaacttctcatgtgaagatgattagcatcacatggcattttaagcagatactcagaacacttgatagcaataagaggtggccatgaatttattggagtagtgcagtagttaatatagttaacgttacgcagttatgatttaacattgcatgtttacatttgtgtacatttctcttgactttgaatgatgccatctatggcccatgaatgtttgtctgcttaagtttcaataaatattaaattttcataaaatattcatacacattttataatagtaatagacaaatatctaaatatatgcattcacagcataactaactttttcttaattttttcaatatttctaggctgcaattttctcctgtgaattttttcaaattattgcaaatctcaaaaataattttaaataaatttattggaaaaaatatgcatgtaggaggacccaggcagatcaaacccatattgttcaagaatcaattgtattttgagcatgatccaaagattgtcttcagacacttttcttgattctaagaatttggtataggcaaggaaactgacataatataagcagtgttcacttaaaaattacagtcaaatatgcaaagactctagaattccataaagctttagagttcagggactgcagttcccaaaggatgacctcaggggtaatgagtaggattactgtgggacctcctaaatcaagtataaatcaaagatgtataagatatcattgtagtttgttgtaaaaaatttattagatattatcattgtaattactacacagaactcctgcttgatagtgttttgtatgtaataagtgcctagtagatatctgctgaatttattcattttgggaccctccatttgttgaaagtctcatcacccacaggacatgaggatcttttagagaaacagacaacacaatgtaaatttagaatcaggagtgcgagtccccccagtttcccagaggaataagtactctccaaagagtgcctccctaatggaggtaatcattgtctttaccataatcctctgcactatcatcatttccctttattgagtacttacttatgccaggccctctacaaacattatcccattcaactcttatcataaccctggagggtacaactcaactccatcacagatgaagatttggaagcctatggtgggtattgttctctccattttacatattataaactgaaactcggagaaatgatgattacttaaataactcaaatagtaaaatgcagatccagtatttaaataatccagatcattccacctttaaatccaccaactcacacagtttcacagttaacatggggaagaggggaaaagggaagtatttttaaatttcattttcatttatattcaagaaaatttactcattttggttacagttctataaattttggcaaatgcataacatcatatagcatgaccacaatcaatatacgggatagttctatgatgggcaccctgaaatttcctcatattgtccatctatatagtcaaaccctttcacatctctaactccttggaactactgatgtgttctttgttcctgtacttttgccttttccagaatggtgtataaatggcatctacagtatgcagtgttttggtctggcttctttcacttatcagaaaaaaatctgagattcataggttactgtgtgcatcagtatgtgtgaaatgcatctgtacatgcaccatcgtttgttcatccattcaacactttaggattattttgctcctagaactagtggtcagcaggctgtcagccagggagcctcagttttcctctacgttgcctctccaacagcagcatgggctcctccacatggtggtctcagtgttctcaaagcgctgggtacaaaagtacttgtgtactgagacttctcctctcttgcttgcgggtatgtttacttacatctaatttgttgctatatatgggccaaagagagtcacttggacaacccccagaattatgactccactttttgaaagcacgtgtgagaaagtcacattgcaagttgtgtgaaatcaggtaaatggcttattactctcttcaaatctcagttggctgttctgtgaagtagttataataacactcacctcttaggattgttttcaaaactaaaaaatgtttaaaaatgaaaagctcctaataaaatatggtcttttcataaatagtgactatgattatccttggagtatctggaaagaacagtgttaggcaaaaaacactaaattacacagaacgtgaagaacatgactcttccctataggaatactagttccttattgttctacgatctcaatgtatgattgcaagttaattatttgatttatttctaatttttaaaataaattacaaaataagcaataaaaataatgaatacatgaaggatttttaatatgacaaatcttgctttacaacctaataaggttattagggataaagttaaaagcattattaaaatacacattattattagaatgggtgacatggtaacgcagcaggatatggttcaatgcctgttggtcttagaagaccagactttgagcaccagctttgccgtgtaatctatggccatgagcaagttatcttacctttctaagtctcagttctctgatctgtaaaatgtggcttacacagctgatgcaactgacccccatgttattgtgaggacccagtgaaatagtatacttggtgtttccgaattgatatatgagagagagagagagagagagagagagaaagagagagagagagaaatgataacactttataatagattatacttcttaaagaattgggataaacatgaaaggtcatagtgactatactatagtgttttattaatttataggatcatcttttcggatagtcacaaatactacccaggccaggccaggcagttgacataattgaatgagtgtcatacaacaggaaatggtatatcctgtagtaaataagggagtttttgtcccattaaaatcagggaatcatcaaccactgcttagtttaatgaaatgaatcttgccacatgggagcgtgggccacatggtaaaagggcccatgtggtttttcaataaaactggaatattagagtttcggatggagttgttatctcaaacacagagctaataaaataaaaatgtagcaaaaaaaaaaaaaatacatggtagattcagcatgcaggctgccatttttgacctctgattaagtcactgtcagctgctttctgcatgtaaacacccatccacattgaacggccatgtgaagcaagctcagcagttcatcttaccttgagcattgatgcttacattcagaaaggacccattatattatggaagatacataagacatatgaaagaatagatcatgtgtgttcatcatcaccttagtttctgttaattaggatcctactcccaatttggaggagaaaggtgcagtaacttttccattgtgataacattcccccaagttggtacatattttggtgatgcctctagagctttgagaaagtcacttaaccacgttccttatctttaaaatgaaggcagtagattagattaaatctacagtgattttcacctgtaatattccatgagtctacagtgagattggtagtaaatataatttcaaacataattttcaacgtgcttttctgtcttatcttgaaaaagaaaagcaaaaaactctgcttatggcttcttgttatcttagcaaatatcctgcaacaaaatattttccttttatatgaatttttaaaaattcattttcaaacatcttcccataggccatggtggttttagccatgggtaaatttcactcatatgccttactatgtaatgacattgtggagtgtaactggctttttaacaccgttaaataattttccaaaatgttttattttaaatagttacaggccaccatttactaatttggtgctaaaaaatttaaaatatctgcttcatgtgaatcaacatttacattccaaatattagtgtgaaaatccacctgttatctgaaaggccttagtttttagaaatgtatttgggaccccaaaattgttcttctgtttcagattatgtttatatctgattattcctaacatataaaacctgttagattgccttgtctttgttcatctaaaatttagctacctccaagctaatagttgaagattatatttgaagcatggatttatttcatgatttgaaaaacaaagctaaggaaaaaattgtttgaaattcttgttcattgcctattcaggccctagcaaaggtaatatgtggtaacaaatggggatgggcagaactgccaagcatatgtggattaactaaaattcacatttaattggctacttttatcaaaccctggccgtgatattgaacaccaagtgctactttagacacttgacaatcatgatctaaaacgaccatgtttaaatggttttttaaaacatccatcaaagttgcattatcctaatgttaaaattaagacatcagactgagattacatacctttctaattactatgtcttcaaactgggatttcagccggctctggttgctgtcgggtctctgggatttccattctgccatgcgtgctgttgagtgtaaggtgcaccattggcctccagggttttagtgtttccagttgtaataaaatctctagttgaccaagaactctgtggttaaataagcaattgggtcatcagctttattaatgggccagcccagtgcctcacagacccaaatacaggccccatctgtggtaaaaatgtaaagaagaccagagcaagccctccagggagcagcccgtattgagctcacctgcttttctgtgggtagagaaactgaagggcagccagcctgtctgcatggaggtcctggagagggaagggagagctgctgcatgaaaactagaaaggcagcctgaatagaacttcatctacaggaaaataagagctgcaatgtcataacatgtactttatctaattttacttttattagataaataatatttttgtatatctatggggtaaaatttggtgtttcaatacatgtatacatggtggaatgatcaaatcaggttaattagcatattcatcgcctcaaatatctatcatttatttgtggcgagaaaatttaaaacttagtcttttagctgttttgaaatggaaaggattggaagagcaaaggaggtgctggaagacatgacttttatattaaggccaaagtaggaaatgaaaagagagaaaggtgtctgtgtctggccatctcagggcagcctctgtcacatcaagctgagggaattcttctctgggcttcctgctttttagggtacagaaaaggtttaataccactgaataattatcccattgctctttctgacatctaacaataaatatatttgcagaaagggaaaactgagtaagtttgtggatctatgttgcctatctgggtataggagtacatacaggtgggtatgaaggatggatgattcaatgtttctgcactccaaaaaatgcagagtaactgtttattatgtggcttcctgatacagtttggtagagaatgcaattaagtgtccaggccttgtgggtgtcatttagggctcagtagcagtagtgccttatcttagataattaatgttgttttatctagtttttgttgttgttgatgttctttgctctttgtttgtgtttgagaataatggacattcagtccaaactgaacagagagcgtactttgcctttatagcctcttcagggacagacagtcttgggaacaagtcacctgtgtagatatatgtaactttttctttcttttttttaaatttaacttttaagttcaggggtatatgtgtcggcatccctgttatattggtaacttgagatataggtaaacttgtgtcatggggttttttgtgcaattattttgtcacccaggttttaggtctagtacccattagttattcttcctgatcccttcctttatcccactccccaccctccaataggccccagtgtgtgttattcccctctatgtgtccatttcttctcatcatttagctcccatttataagtgagaatctgtgttctttggctttttgttcctgcattaatttgctaaggataatgtctgccggctccaaccatgttcctgcaaaggacatgagcttgttctttttttgggctgcatagtattccatggtgtatatgtacaacattttctttatccagtctatcactgaagggcatttagattgatttcatgtttggctattgtgaatagtgctgcaatgaatataaacatgcttgtgtctttataatagaatgatttatattcctttgggtaatacccactaatgggattgctgggttgaatggtgtttctgcctctaggtctttgaggcatcactacactgtgttccacaatggttgaactaatttacactctcacagagtaaaagcattcctttttctccacaacctcatcagcatctattgttttgtgactttttaataatagctattctgactggtgtgagatggtatctcattgtggtttggatttgcatttctctaatgatcagtgatgttgagctttttttcatatgattgtcggccacatgtatgttttcttttgaaaagcatctgttcacatccatttacccacttttcaattggactgtttgcttttcttcttgtaaatttgttaagtttcttacagatgctggatattagaactttgtcagatgcatagtttgcaaaatttttctcccattctgtaggttgcctgtttactctgttgatagttctctttgctgtgcagaagcgctttggtttaattagatcctgtttgtcaatttttaattttgttgcaattgctttttgtgtcttcctcatgaaatctttgcccgttcctatgtccagaatgttgtcttccagaaattgaaactagatttcttccttatactatatgcaaaaaataacttaagatggattagatacttaaatgtaaaacccaaaactatatgtaccttatctttggtatcctgggaatttttctgaattgttttgtatagccaagtctcccttgcagcctcagtggtcaaagggctgcttttatttgaaacagtcctttagaagagatataaatgaactggtactaatttagctgagaaaaacaaagatccaatcccagctgtgaaataaggtcaaagtcataagacaacattacataaaacgatgagcatttaatattacactgggaaatagaaaaatagataaaagatgagaactagagaaaaaggcagcatttaaatagggacaagtaatatgggcacaatgaaagaagaagagaaaagatacatagaaatggaataaaataggaaaattgtgagattctctggataagaaatgaaaagcatatgtaatattattttaaaatagattttagtgaaaataaaggcaatgatataagtaagggaaaatggcagtttttgaaatataatttacagatcacgatggataataagaaacgttatctaagtttttgaaacctctcattgtttaatgcattatgaagatgaatgtgtgtgaatgtgtgggtgtgtgtatgcgtgtgtgggtgtgtgtgaaaaatattagactcatttaggaaatatacagagcatcaaaaatgtcacacacatcttgttatgtttcatgaaataatattggtacctggctcattctgtctcaactggaataatttatctttggtgtattaatctctgaccctctctcaatgacgacaacaacaacaatgacaacaacaaggaaacattcactagacaacataaggaagttctaattaaagccctaaaaagtatttagtagaagaaacaaaattgacaaactatcagagctgccaaatatttaaacattttaatagaataagactatgaaaaaaatgtataggaaaactccatgcttttgaaattgttattactggtcattttactctgagtaagagttaagtgtattggcaatcacttggcttcacagtaatttaaaaccaaataaacatgtaacaaagggaaatatatttattatatcatcataaagagcattttggtaactataaactttaaaaaatgtgtatgatttgaaggagacttttgtagtggagtgaagctcacttttattgccaatttgtaagtttacaaacataatttaaataagttttattagtagtagcaatgagaagttgaaatattgaaattttgctgtattttatatatattttactttggctatatttatattttggctgtattaacttcaaaaagttatctcgcttacctggccacttcattatgcaaagaaaagcataaatgtattatattcattgaaccattaaatgggagcctagcaaagcaattaaaattaataggtcattccagaacatgatagatatagtatgaaaaaaagaaaacctgtgttgattagctgtcaaagtgttgcatctgtttgtcaagatgaacagagaagcaactatttttagtaactgtctttccatttttatcatcataattcatatggtcttgtcattttttaaaactgcagattagaattttttaaatatttcaaataccctcttcaaaaatactacaaataaaatatatgacttagagataaggaaaattaattttatattcagcattctcagtctcctggactgtaacagcagtacaaatcttcatgttgataatgtgcagaagtgttggtttattggcatgaaagtttaagtgaaaggttaagaaagattaacatggtgcaggtctctaaatttcagtagaatcgctggtcatacttagtggaaaacgtaaatgaaacattattagtttatgaagagacaccagagtattgcatatccatgatttttcttaaagaactaaagtgtttacatttgtaatacaatattctatggttggtattgaggaaattgataaagatttctcccagattttcttctaaaagctttatagttttacctcttatatttaagttgataatcaggtttgtatactttttgtgtatggtatgaggaaagggtcaaagttttttttctatatttatattcatttattctaaatccatttattgaaaacacgatcttcatttcattgaatttccttggtatctttgttgaaaacccatctacaatataataattgtgggtatatttctggactcaaaattccttttagttgatctttatgtcaatccttatgccaatctcatactccttagagtgcttttattgtaaatcttaaataccagctaatttgattcatctgattttgttttttcttaaaaaaatttttaagcttttctagattatttgcctttccttacaaatattaacattggcttgtcaaattcttatatagagactgctaggattttgattctgaatgtattcaatttatagtcaattctggaagaattgacctcttaaaaatggtgaattttcaaattaataaaaaagtatatatttccatttagataagccttaactttttaaagcaatgctttagagttttcagttcacagacattgcacatctttttgttaaatttatttgtaagagtttttctttttatggtatatgctgtagttaattaaaatttgattttattgtcaggttgtttatttctggtgtataaaataaaattgatttttgcatgttagtttatatcttgagaatgtgttagactcattagctttaggaagctttatattaggttctttaagattttctacatacaccatgtcatatgcaaataaatgcactattgttacttccattctaacatgtgcctttcatttatttcttttttgtcttgctatacttgcagcggtgagagtggacattctttgcctttttcccaatttcaggagaaaacattctgtttttcatcattaaatatgaagttagttttacatttttcatagatacgctttatcaggttaaagacgttttcctccatttctcattacatttttttttaaatcatgaatggtgctgaatcttgttaaatgttttttcttcctctactaagataatcttacagtttttctctttattacatttaggtaatatgcttagatacgttacatttatataatactacatttgttaaccttcggatgttaaaccaactgtgtatacatgagaaaaattacatttgttcttggtgagttattgtatttttttcttgactgtaattgctattttttttttttaatttaaaagtaaactttaatgtcaaaatgcaaacctggggagggcataaagatcacacacaaggctgccacttcacacttggagggttgcacagtggccagtcaaaggcgctcctcacttcccagacaatgtggtggccagacagaggtgctcctcacttcccagacctggcggcagcggggcagaggcgctcatcacttctcagacggtggggcggccaagcagaggtgctcatcacttcccagacggggtggcggctgggcagaggcgctcatcacttctcagatggtggggcggccaagcagagactctcatcacttctcagatggtggggcggccaagcagaggcgctgctcacttctcagacggtggggcggccgggggaggcgctcatcacttccccgacggggcggcggctggacagaggcgctcatcacttctcagatggtggggcagccaagcagaggcgctcctcacttcccagacgggtcggcggccggacagaggcgctcatcacttctcagatggtgaggaggccgggcagaggcgctcctcacttcccagacggtgggtcggccaggcagaggcgctcatcacttctcagatgatggggcgacgggacagaggtgctcctcacttcccagacggggcggcgacgggacagaggcggtcctcactttccagatggtgcagcggacgggcagcagcgcccctcacttcccagaccgagggaggtgcggggagaggtggccaggcagaggcgctcctcacttcccagacattgcgcggggccgggcggaggcccccctcacttcccagacggtggggcggccgggcagaggcgaccctcacttcccagaccgagggaggtggtggtggggggtggcccggcagaagcgctcttcacttcccaggcggtgcgggaaccaggcggaggcactctatttggtaatatctttaaggattcatgaaaaaaaagtctatgaaacaaacaaattgagaatcgtcccattgtacagatttaaaattattttaagcaagagacttttctttatagctaaatatctaaatatcagagtattttttgtagatgcttatgtaaattctggaacgttgttttcaattttaataaagatatttatccaaagttccacacacatccacatatccacacacatacatatatatcctgatatctatcttcattagcaacatatcttaattatacatatatcttaatttgatagatatcttaagcttctctgaagtgataagtagatatagatctcaattagatatacatattagaagatagaaatacttgagcaattgatcaatagaggttctgctttttaaattaaaaaagtagttgcatagctatttttaaatgttaattattctttcaaagaaactgatgaattttcctgttaaaaaattgtaaaatgtgtatttaaatcacccatatagtgaggcttaagtctccagatttattactttatgagctaccagaattatagaaatgtggcaatttattttgaagaaaaaagaggtttttaaaaatgtactaccacattattttaatagcacactatacagacatcagtacttacagggaaaaccttaatcctttagtgtaatgtttagtgttaattatgtctctctcacacacacacatgcacacacacactttcttagagctgctttatttttatcctcagaagacccttatgcacaaaggtgattgtttccactatagaagcttcccttgtgtgattatttcccttttagaatcttaggcagttcagtttagagaagtcccctcaaaagcccccttcttatttggctaggccgcaacccggtgcctaagcctatactctccttagtgtatcagtgctcttcaggacaattatacaatgaaaagcttaggcttttcttacaaaggcagtttatactggaatgtaaattaatttacagaattaattctcagatattccttgtattaaaaggacaaggtatttcctgggcactccatagcttaagataccaatgtgtttatcatagtatttttatttcactttttgcttaaacaattgtggctcttaatttatagtagaataaatttgatgtgtgtgttaactttctactaattaataacctgataattttagccctacttaccctgtctattctgctaaaccaaattacaaaatttacactttactcctatgacaagttcttcattattttgcccctgtaactattcttgtgttaatcactattaggaaaatgtcccctacctatcacttcagagaagcttcttattgcggctttgtttcccaggtaccaggttataacgacttactttggtatttgttataccaagtgattgtgatgtctgaacttccctgacctcagtttatcatcagagggaaaaaggacaaaagcccttgagcgggcagtgatatacatacaggttttaacaatttattgtgcacgacagatgtaaactaaatattatttaggatattgggatatgtggggtgttctttggggtgttctagaagaatcatcttaaaactctcccagcacaaaagtggtgtgtctgttatcagtggtgccatcacagatctttaaggttttaaggtttaacaggaaagccactggcctcagtgctcgaaggaccactgatccttgctaccaccctgatatttaattagaggagaaaataaactttatcatcccatttgtgccttttattatctttttccttaaaaaaaaaagcacaatgaaccaaaacttctaaaattcacctttttttttcttttggtggaacaaagatgtgttagtattagagttgtttattttgtttaaaggatttctatcttgaagtatgtactttgttttcctcaggagcacaaaccactctacagacaataactcacttagatctttcaaattctgcagagagttgtaggtgataagtagtatatgcaatttacagggaggacaattgaaatagaggttgcctctaattgctcagaatcagaaaccacaactataatggaattcagaatagaatctgggtctcttgactcccaattagttctctatccactagatcacactccctactcctcagtccttggaaaatagatggtaaattttacataaggctaactctgaattacctacagtttgtaatgagcgcctacagatgctggtttacattcacatcattgccctggagtcggcgctacggcatctgccagaaacctgtggatcagctgtcttgtgctactgtggcaaagccaggaagaaaggcaagcaggaggagagcaaagggagcagaaagagtttggatgtgggaaacacagaacttataaaaatcaggggaacattaatagttgtggagttggatgtcaagactatgccaccatctatgtttgtgcagatggagacaaattgagatggaattccatccttatacatcattttccacatacaaacatggacactaacttaagggtaaaactggtgggagaggggtgcaggcaccatgtctggccacgaagctggcaagaagccccccaaacagcccaagaagcaggctgaggagatgaacgaggagataacattttcaagcagaagcagaaagaggaacagaagaaactcaagaaactaaaagcagaggctgcagggaaggggcccctgggcaaaggtggaattaagaaatctggtaaaaagcaagctgtttcttgtgccggaggccatggtgaccctgaattccatccctatttaaacatctgaatttcctgctgtaacatcctttgccacctatagttagaatgaagtgtcatcttagagcctgccgcacatttaagaataaacttttgtaaaaataaataaaataaaaataaaagcaaatctaaaccacaaaataagcaagtaacatgaaaactagagctttggcagttctgcaagaacttccattgcataggcagatttcatgtaagctgttgaatctctagtatcaatggtatggcatgactgaaagtacatggtagtaatttaaaagtttccaagtgagaatggtgacaaaacaaacacgttacaagcctcaatagggagattattcacataggtagtatttggacatggtgtcttgcagcaataaactgtagcgtgttcactgttagcagagtgaactgttactgtcctgttttagttatgattgtctttattttgattactcagaaatttctaatatatcttcttgaagatcagagtgggttgtgatgttaaatataagaaattataggccgggagcattggctcatgcctgtaatcccagcactttgggagaccaaggcaggcagatcacgaggtcaggagatcgagaccatcctggctagcatggtgaaaccgtgtctctactaaaaatacaaaaaattagctgggcgtggtggcacacgcctgaaattccagctactcttgaggctgaggcaggagaatcacttgaacccggaaggcagaggttgcagtgagccaagatcatgccattgcactcccgcctgggtgacagagcgagactccttctcaaaaaacaaacaaaaaaaaattgtcaaaatttatatgggataaaactactcaactttttttgtttctattatctggagatatttacatcatttttttcagaagataaacttaaggcatgaaatacatgttcagggcagggcatggtagctcatgcttgtaatctcagcacttcgggaggccgaggcgggtagatcgcttgagatcaggagttcaagaccagcctggccaacatggtgaaaccccatctctactaaaaatacaaaaattagcagagagtggtggtgggtgcctgtaatcccagctacttaggaggctgaggcaagagagttgcttgaacctggtaggtggaggttgcgtgagccaagatcgcgccactgctctccagcccaggtgtaagaggcagcctctgtctcaaaagaaaaaagagagagagagagagaaagaaatacatattcagtgctgagatttgcttaaacaagcaacaattgtataaaagaagaaagaatggagagtgtggtaaatattgaaaatataaatgactatgtgatctctcaaaggagcttttggtacaattcctgatgaccagaatgtatgaatctcattaactacaccttagaatggtgcctggtgcatagtcagctctcagtaagcatctgcctaaatgaaagacatagaaaagccagctttcagtaagttccaggatgcaagagcagtgaggaaatggagagagtcattatcaaaacatcagctaacatgcttgaagtaaggaggaaacatgaattgtctcagagatgtgcaagcttcttcacagagttaaaaactgagacaatggtctaatataggggagacagtgtggatgacacaggagagagagggacagtatataagacaaggctcctgaacatagaggggctaggacttccagcagaagtagagagtttggcttacatgagaggaggaacatttttttgttttgttttgttttgtttattcagtagtgaagggaaaacaagagatcacaattcaggctagtcagttgtgagagttcctgtgtggtagatgctatattttcttttttttttttttttttttgagacagagtttcactctgtcacccagactggagtgcagtggtgtgatctcagctctcagcaacctctgcctcctgggttcaagtgattctcctgcctcagccacccgccccccagtagctgggattacaggcctgcaccaccatgcccagctaatttttgtatttttagtagagatggggtttctccatgctggccaggctggtctcgaactcctgatctcaagtgatccacctgcctcggcctcccagatttctggcattacaggcatgagtcatgacacctggtcaaatgctatattttctagaaatcggatgttttgttaagattgactagaagtatgaaccataggggtgtagaggaagcattgacaaggggagtgtcctagcaattgttgtaggacaggtcttgtgttcatgaaatccctcagcttttttttgtctgggaaagtcttcatctctccttcatctttgaaggatagtttcactggatatactattctacaataaaagttaacagtttttttttttcttttgacactttacatatgtcttgccactgtctcctgtcctgtaagggttccactgagaagtccgctgccacatgtattggagctccattgtatattatttgttttatttctcttgtcacttttagaatcctttctttatccttggcctttggcagtttcattattaaatgtcttcagatagacttacttaggataaatgtgcttcatgttctgtaaccttcttgtacttggatattgatatctttctctaggtttgggaaattctctgttattattcttttgattaaactttctacctttctctcactctctctctctctctctacatcctctttaaggccaagaactcttagattttcccttttgaagctatcttccagatcttgcatgcatgcattattctcatttattctttcttttgtcttctctgtctgtgtattttcacatagcctctcttcaaattcactaattcttctgcttgatcaatgctgctattacaagactcttatgcaccctgcagtgagtcaattgcatttttttaactcagagtttctgtttgattcttttaaattatttcaatctttgttaaatttatctcataggattcagaattccttctctgtgtcatcatgaattttgttgagtttcctcaaaacaactattttgaattttctgtctgtaaggtcacatatctctctctccataatgtttcactggtgccttatttagttcatttggtgaatgcatgttttactggattgtcttgatgcttatggatgtttatcattatcgaggcattgaagagttaggcatttatagtagtatttgcagtctgtgcccattcttcttgggaaggctctccaggtatccaaagggacctgggtgtttttatctaagtttttggttactgcaggcatatctgcattaggaggaaccccacgcccagtaactcgaaggatcttgatgactcctagaagtactgcctttgtggtcttggataaaacctggaagaattcactggattatcaggcagagactcttgttccttcccattactttctcccaaataaacagagtctttctgtctgaactgagcttctagggctgggaaaggcggtgacaccatcatggggactgcaccaagttaggcccaaagccagcacaacactgggtctcacccaaggtccacgataaccactgcctggctattgcctatgttaactcaagtttctagagttctagaatctgctggtggtgaaaccatccaggcttttctctcaaccttcagggcttcaagtgtcccctgatcacagttaggtccagagatgctgtctggcagccagtccctggagtcacaaaccttaggtatcaacctggtgctctttttttattgtggttcagctgacaccaaggcaacaagaaaacatctttcccacttttcccttcactttccacatgcagaggttttgctccccatggtcaccaccacccaagcctgtggtgagtaatgtctggttaccaccaatatttattcaagccccaagggcttttcagtcagctggtggtaaatgcttccaggcctggaactctcttttcagagcagtggactcctctttgactcagggcaagtcaagaaatgctctctaagagccaagacctggaattgggaacctcaagagcccatttggtgtttgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtaagtgaatttaacctctttcctttgtaaattacccaatcttgagtatgtccttatagccgcgtgggaacagactaatacagtaaattggtaccgcaaaaagtggggtgctgctgtaaagataaccaaaaatgtggaagcaactttggaactgggtaacaggcagaggttggaacagtttggagggctcagaagaagataggaaaatgtgggaaagttgggaacttcctagagacttggtgggctcagaagacaggaagatgtgggaaactttggaacttcctagagacttgcggaatgtttgaccaaaatgctgatagtgatatggacaatgaagaccaggctgaggtggtctcagatggagatgagaaacttgttgcgaactggagtaaaagtcactcttgctcttcaaagagaatggcagcattttgcccctgccctaaatatttgtgcaactttggacttgagagagattatttagggtatctggtggaagaaatttctaagcagcaaaacattcaagaggaagcacgcctaaaagtttggaaattttgcagcctgacaatgtgatagaaaagaaaaactcattttctggggagaaatacaagccagctacagaaatctgcataagtaacaaggagccaaacgttaatagccaagacaatggggaaaatgtctccagggcatgtcggagaccttcatggcagcccctttcattacaggcccagaggcttaaaaggaaaaaatgggccagatccagggctcccctgctgtttaacctcaggacttggagcccttcatctcagccactccagccatggctgaaagaggtcaagttacagctcaggccattgtttcagagggtgcaagccccaagccttggcagctaccatgcggtattggtcctgagggtgcacagaagacaagaattgaggtttgggaacctctgcctagatttcagagaatgtatggaaatgcctcgatgtcaggcagaagtctgctgcaggggtgaagccctcatggagaacctctgctaggaaagtgtggaagggaaatgtggggtcagagcccccacacaaagtcctcactggggcactgcctggtgtagctgtaagaagaaggccactgtcttccagaccccagaatggtagatccactgaccgcttgcaccatgtgcctggaaaagtaacagacactcaatgccagcccatgaaagcagctgggagggggactgtacctgtaaagccacaggggcagagctgcccaaggccatgggagcccacctcttgcaacagcatgccctggatgtgagacatgaagtcaaaggagataagtttgtaactttaaggtttaatgactgtactgttttggactcacatggggcccgtagcccctttgttttggccaatttatcacatttagaataggtgtatttacccaatgcctgtaacctcattgtatctaggaagtaactaacttgcttttgattttccaggctcaaatgcagaaggaacttgccttgtctccagtgagattttggactttgacttttgagttaatgctggaataagagtttggagaacttttggaagggcatgattgtgttttgaaatgcgaggacatgagattttggaggggccaggggaggaatgatatggttttgctgtgtctccacccaaagctcgtcttgaattgtagatccaataataccaacatgtccttggatggagccggtaggaggtatttgaatcactggggtggtttcccccatgctattctcatgataatgagtaagttttcataagatctggtggttttacaaggggcttatgcatttgcttggctctcattcttctccttcctgtcaccatgaaaagaaggaaaggacacgtttgcttcttccttcaccatgattttaagtttcatggagcctcccctgccctgcagaaccataagtcaattaaacttctttcctttatatattacccaatctcaggcatgtccttatagcagtgtgagtatggattaatacagtgctataccctactgtgcctgagctcttacctatgctgtaagacaaaatactgtgtacttttccctgtcctttcctcaatcagtagtttcttcccatggccaccatagctgagaatgtgttaggtcacaccgaaagcaagcacatctctgggtctcacctatggcccatggtgagcactgcttgggtatcactgctgattattcagggcccaaggactctttagtcagcaggtgatgaatcctgctgcaaccgagtccttccttttaaggaagagggtttcctcccaccctagtgtatgtttggaaatgtcactggaagctagggcctggaataggggcctcagtactctgcctggtaccgtatcctactgtggctgagctaatacccaagttggaatacaaagtcctctttacttttccctctcctctcctcaagcagagggaaagagcctctcctggagctgcaagctgagtttcctgccattgggctaagggtggcacaagcactcctttggccacccctgctggcgtctcactgggttgcatccccaccaagttcactggctctgagcccagcacagtaccaagacttgaccaggaattgcagcctttgtggcttaagccacttttcaaagttatgtaggaccacagagtactttattagcctgtggtggtggagctgcaagaactcaggttctgaccactgggattaacaattttcctctagctagggctggcataattgctccctctgcagatgctggctgagttctgcctggtgttactttccactgtgacagagaagcactgagttccaattcagagtcccataatcactgctctctccgtgccctaagcacatagattctccatgcggcagtgctgctgctgggtggtagtggtgtgggggtggtgtggttgcctttcctaccctcttcagtgcctctttcagtgatgtgagctaaaaccaggtactgtaattgctcacctgattactggttcttatgaaggtgcttttttatgtgaatagttgtccaatttggtgttcccatggagatgatcatcagtggatgtttctatttggccaccttgctctgcctcgacattcaagtgttcttcatgagccattctcattttagaagctcactgatttctcttttcttttaattaacaaactattaataatttacaccatacaagttattacttggctgtaaatcatttttaaaccagtatccaattatttgaaatttatgagtctcctttctccaataagaatataagttctttgatcaatatggctcactacagtaaaaccaaggataatttatcttactcaccataatgtttaatgaagtattgttccaaagtttttccaaagagaagtcactccttatacttagtgtctatcctcagtgcctaacacgtggctgagtacatacaaggtattcaataaatgcttgttgaactgatatgggcaactattaaatacttagttcatgcatataatttcattgcttatgctttcaatgtcttaaaatggagaagacctcacctcacctgaatttgtctgctgtaaaatatgaactatgtatgtaagctcttaagagagagcttacataaatttaagaaatatgtgaaagttagatcatgcccaagatttgtttttcaaacataagaaaataaaatacatcactgaaggtataagtcttttatgagtcttttctttctcataaaaataaaagtaagatactttagtcacttttattttaaaacaatatacatttatatttggaagctgttgctttctgggctgtaaaatttgctttatcactggacctgagaaagacctataataataatgttaaaatattttatttcaaagcatcatatttatatacattgagataccatttatgtcattttaatttagacctcaaaatatattttaatgaatctgctgatttatatgaagtctttatgcacaccaaatacttaagaatattcctctattaggtgttcctgtctctaactctgcatctgaaaaggggacttgaatttttctcaaattcttatgtgatcatggcaaattaaaacagacaactctgttgctccatatgtaactttctagaaactctttcatgaaaaatattcatttagaataagtttcaagcaatgtttcaatttgtttcagttgtaaacaagatattttcctgtatcattatcaaattagccacaatgctgatactgtcatcactggctgaattagaatgtttgtaacaatatagacatttgaatgtaaaacatttgcaataatttttctatttaggattcttttactggacatttaggtattaattttaattgactttccaaatattacatgcttactggagaaaaaagaaagtaggtattaacaaagaaaaaaactcataaatcaaccattcagagataaacatattaatattttaatagatttttccaatattttgtgtatatatacagctatatgtatatatatatacacaaaaattatatgtatatgtgtgtatatatatatatacttgcatgctttttttctatcttttaggatcatggtatatagagagttttaaaaaattaacattgcattgaatttattatctgacaagactagatagttgttttttttttttttttttgagacggagtctcgtgtcaccgggctggagtgcagtggcatgatgtccgctcactgcaacctccgcctcccgagttcaagtgattctcctgcttcagtctgtggagtagctgggactacaaggcacgcaccaccacacccagctaacttttgtaatttttgtaattttgtaattttgtaaattttgtatttttagttgagttggggtttcaccgtgtgagccaggatggtctcgatctcttgatctcgtgatccacccgcctcagcctcccaaagtgctgggattacaggcgtgagcccccgtgcccagcctgactagatagttttcaaaaatataatgtttaggctcatgcctgtaattgcattggtttaggatgatgacgtgggaggatggtttgaggacaggagttagagaccagcctagacaacacagagagaccacgtctctacaacatacatatatttggtctatgtggtggcacgtgtccctaatagctaccaggaggctgagacaagaggatcacttgaggccaggagttggaggctgcaatgagttatgctcgcacagttatccagcactctacgctgggtaacagtgagaccttgtctctaaatacatatatgttacagagtgagaccccataggatcgcactgtattatagtctatatatttacccatctgcttcatttattttcaccacatattttagatattattttttcccattttccttttatgtaataaactttgaacacaaaattttgaatacagctctacttattcatcacattacttatcacagtagattttaagtggaatcataatctcctaagaatcttgatcaacactttcaaaatatatttttaaaggccgtgaaaatttatacatccatctagggccaatagttgtatttctgcttatatgtgaatatatacagcccttggagttgtgcagtatacagcccacaagactgaactggtgattttactctcacctgtagagtatgactgtacccatctcactccactaatattaaatgtaataaatttaaaattattaatagtatgaaaggttaaaaataaacatgtttcttatagagcactaaagttcaattgcatttagcagagatctttaaaaactgtgttgtaaacattatagacatttatttttttctcacttagtggtttagaggaagtagaggtgattcgtgtctggcagtaggtttttctacaatgtttttcaaagatctctgtggctgttaacttttgctctcacccaccttggtctaagttagtacaccactgccattaccatgtccaaacagcattatggaggaaagtgaaaaagtgaagggaagtagaatttcctttctatttaagggaacaatgcagttttctttataaaaaaaattctaactttgctttaaaaacttctgttcatatccattagtcacaaattagtcacttagacaaatctaattgttagagaaactgggagatgtagtgtttattttgagtttgtcaagacccatctgaaaactaggaattaaatattgcggaaaaaatagaaaaatggttttgaagaattattactctctgccatacagagaatcttacatttgcaatatatttgatcactggtgagattgacattttttcatgcgcttatataatttcttacatcaattacaagttagtgttctgtgctatttttgtcacggaagtgttttttggaaaggactttctgtataatatttatattaacttttttttgttgtttttgagatggagtttcgctcttgttgcccaggctggaatgcagtggagcaatctcagctcactgcaacatccacctcccaggttaaagcagttctccttcctcagcctgccaagtagctgggattacaggcatacatcaccacaaccagctaattttgtatttttagtagagatggggtttcaccatgttggtcaggctggtctcaaacttctgacctccggtgctcctcccaccttggcctcccaaagtgctgggataatagtcatgaaccactgtgcctggcatatattatcggttatactcattttaagtattattcttatactacttttttatttattggaattttacaggcctatgatcacatttttattatcattatacttagaaagtttttccattccccaagatgttaatatttattaatatttcattacaggattaaataaatttagattttatttaaaatgttattttatctttagggtttttgtttgtttttgttgtttgttaaggctaagaagaaaaatatccaacttcagagttttttaaaatacttacttttctttactaatttttaaaattatttatttaacactaagtaaaaattcagaagattttatattgtgctcatatagtttagcacttttttttttggttcactaccttatagtcctggctcactttttattaaatattcaaaaattgtacacacatgattttaaaaagaataaggttatcctcaatatttagcaactttttaaaatgtttaatgagtttttatttttttcaactatttttaagatacagggagcacatgttcaggtttgttacatgggtacattgcactcaggtagtgagcatagtacccaataggtaattttgggaccccctcctcctccctcccttccccctctgtagtctgcattgtctattgtttccatgttcatgtccatgtgtgttcaatgtttaggtcccacttataagtgagaatgtgtggtatttggctttttgtccctgcattaatttctgaccctggttaggataatggcctccagtgccacacatgctgctgcaaatgacatgatttattatttttttgtggctgtgtagtattccatggtgtgtatatgtaacattttctttatcccatctaccactgatgggcacttaggttgattccatgtatttgctattgtgaataacaaggcaatgaacatgtaagtatatgtgtctttttggtataatgatctattttcctttatgtatatacccagtaatgggattgctgggttaagctctaaaattatagaactgaatgaaattgagacgtaagaattgatacaaaagatcagtgaaaccaagaattggtactttggaaaaaaacaaaacaagataagattgataaaccactagctagattaacaaataaaaaaaagataagatccaaataagtgcaatcagaaatgataagaatgacattataattgatccccacagaaatataaaagatcctcagagtatactatgaacaactctatgcacataaattacaagatctagagaaaatgatgaattcctgaaaacacataatgtcccaagactgaagaaggaagagattaaaaccatgaatagaccaatatcaagctctgaaattgagtcagaaaaaaaacaaaacaacaacaacaaaaaaatcagtgaaactgccaaccaaaaagaggcagtggacgagattaattcacagttgaattctaccagacatgcaaagaagagctggtgccaatcctactgaaaatattccaaaaaatggaggcagaggggctccttcctaagtcattctatgaagctagcatcagcctaacaccaaaatatgtcagagacacaataacaacaataacaacaaaagctttaggccaatatccctggtgaacatagatataaaaatcttcaacaaaattctagcaaaccaaatcccgcaacatatcaaaaaatttaacacaccatgatcaattaggctttattcctgggatgcaaggctggtttaacatacagaaatcaataaatgtaatttacaatataaacagaattaaaagcaaaaacatgagatcctttcaatagatggagaaacagcttttgataaaatccaacatcccttcatgataaaaagcctcaacaaactaggcatttaaggaacatgcctcaaaatggtaagagccacctatcacaaacctacagccaacatcatattgaatgggcaaaagctggaaccattcattcctcttgagaacttggaacaagaaaaagatgcccactctcaccactcttattcaacgtagtactggaagtcctaatcagagcaaccagacaagagaaagaaattaaaggcatcgaaataggaaaagaagatgtcaaactatctctcttccctgatgatatgattttatatctggaaaacccttaagatgatgtcaagagactactagaactgataaacaattttactaaggattcaggttacaagacagtgtacaataatcagtagcatttctatacaacaataattcctggctaagagtcaaataaagaacacaattcccacctctacaatagcaacaaagaaaatgaaatacctaagaatacagctaacgaaaggggtgaagtatttctacaaggagaagtacaaaacactgctgaatgaaatcagagatgacataaacaaatggaaaaacattccaggcttatggattaaaagaattaatatagttaaaatggccatattgcccaaaacaatttacagattcaatgctattactaaaaaactaccaaagtcattcttcgcaaaatgagaaggaaaaaaataaaagctattctagaattcatgtggaaccaaaaaagagtacaaatagttaaagcaatactgagcataaagaacaaggccaaaggcatcacactaaccaaattcaaactatactataaagatatagtaatcaaagtagcatggtactggtacaaaaagagacacatggactagtggaacagaatagaaaatgcagaaataaagctacacatttacaaccatctgatcttcaataatgctgacaaacaaaaacaaacaaacaaaaaaaaacagtggggaaaggtcttcctattcaataagtggtgctaagataaccggctagttatatgcagaagattgaagctggacccctacctttcactatatacaaaaattaactcgaaatggatcaaatatttaaatgtaagacctcaaactataaaaattccagaagaaaatctttaaacagacaatctacaggatgggagaaaatattcccaaactatgtatccaacaaaggtctactatccagactctataaggaacttaaatcaataagcaaaaaacaaataaccttggctgggtgcggtggctcacaactgtaatcccagcactttgggaggcagaggcgggcggaacatttaaggtcaggagtttgagaccagcctggcctcaaactgtttagtagagacatggtgaaaccctgtctctactaaaaatacaaaaattagccgagcatagtggtgggtgcctgtagccccagctactcgggaggctgaggtaggagaatcgcttgaacccaggaggtgaaggttgcagtgagctgagatcgcaccactgcactgcagcctgggtgacagactgagactccgtcaaaaaaaaaaaacaaaaaaaaaaaaacagcaaaacataacaacaacaaaataacctcatgaaaacatggggaaagaacatgaacagaaacttctctaaagaagacatacaagtggctaccaaacatatgaaagatgctcatgatcagtaatcatcagagaaatacaaattaaaaccacagtgaggtaccatatcacaccagtcaaaatgactatcattaaaaagtcaaaaccgacagatgctggccaggctgtagataaaagggagcacttatacactgctggtgggaatgtaaatttgttcagccattgtggaaagcagtttggagatttttcttagagtttaacatctctttaaggactatcagttctgttttgttgctttctccagggctggtgttcagtaagcacacatgtctggagtgtggtatattctaccaggatacattctgaatatttgggacaactgccacaccacttgttaaatatttttgactatcacccttgggtttattcattggtttttgcctgagcctcacattatgtaatttttctaccttattatgttgaattattaagtgtttttcatatgtagagggtattcaaagttcaatatattttaaggcattatttacaactttggtttcccaattccattttaatcaagagctaaataaatagaggctaatgtcaaaactcggtgatttaaatctctaaacacattcaaggaaaaaactaaagtataaaattcaaatcacgttttgactaagcttattttcttcataaagaaaatgttcagctgtctcagaataaatgtacattttaataaataaaagatatcataatataggaatgtctttatattactttagcatactttaaaccaacaccaaaataggagatgatataacttatgatttattgagttataacttcttattctaattccaaaatatttaattttattgccatatgctttcacagaaagccttatgtgattttgtttttttaaactgtttctcattaatattagacataataggaacttatttatactattagacatagataataaattactgattagtaattgaataaatcagcaatgaccaaaatctgaagtaaatgttgataaagcttgggaatatctttttgtacttctgtgtgcatacgtatgtctttgatttgggactttttgtaaaattaagccacctgaatactattcaggatgagtaaagacattttctatttatctaccttatgcctgcattccagccttcagtacagactatatttaccatagattgctttattttaagctgtataataagattttctttaaaatgtgttatttctgtttcaatgggattttctgtatactgtgtaaataaaaggagctgcattataaatgaagcaaatacaattatggttgtcaagacacttgaggatttgattaagttttcaaatattttgccatttacattgaggaatgggaagtgtggaaaaaaatcaacgatactgttcttttgatgctttgttttagtgtataatcacctcttaataaaatgtgttgtgtgacagttagcaacaattctgctgttcgtggcgttaatgccgaagatctgataagaggagttgcaggagtgtgaaaaatgagtcaacttttctagatattttctataaattggatccaataaagtacaataaatatgtcttcaactggtcttacaaagcttttatctgagttgggtacaggtaaaaagaacagtatctcgtgaaatctctgattgttccttttgtttcagggtcttagtcagcagtcagtatttaactatgatacatgaaatgttatttcttttaggttagaggtaatgagaaaaatcaagaaatattaggaaacatgttatatacagtagtaatttatcattaataatttgtaaatattatcagagtgaaaattcagagactgacaagggcatttacccagcacactttcaagtcaatcattcactgtgtaggattaagatcatgtgttttgaaactcatgtattttgagttgaatctcaggcaactatcagactgatctagatgtcatcttactcttctgtgaattgggaattaattagaaatattatatatatatatactatattatattacataattttatactatatatactatattacatataatatatattatgtataatatataatatactatagtatatatgtattatatactatagtatattatataatatatattatattacaatatactatagtatatatattatattattttatatactatgtataatatagtatattatatataataaatataatatacactatagtatatattatatactatatatatttatatatatctacttaataggcttgtaaagcttgagatgataaatagatgatgatgatgatgagagagatcagaaaagtctggattataataattgctaaataaatagtaattcttcattattagcatcatcatcatcaattgtctacatagttgtcaagaagctgagcatcttggcttgccatatttttattttctaaaataataaagtgattaatgatacattaaaagctaatattaactgcatatagactccactctttcaacaccttcattttttaattacaggttacatattacggatgatttaaggttcagttttgcattaaagcacttgttgatgtgtatgcatatcctacaaggacatgttgaatataatctacatttataaactatagaaactacttcttccttttgcaggtacagatgattcattataataattttattaagaattattattattattattattattttgagacagagtctcgctctgtcgcccaggctggagtgcagtggcgcgatctcggctcacggcaagctctgcctcccgggttcacgccattctcctgcctcagcctcccgagtagctgggactacaggtgcctgccaccatgcccagctaattttttgtatttttagtagagatggggtttcaccgtgttagccagatggtcttgatctcctgacctcgtgatcctcctgcctcagcctcccaaagtgctgggattacaggcgtgagccaccacgcctggcctaagaattatttcttttcatactcctgaataatgagtccccttttttctgcaccctcactgccgtgtctaaggtcttgatcttagcctttctgggaaaatttgggggctcataaagacatctgctccactctttgccttccagccgtctaccatctacaattcatactcattaaggattcaatagctgtattcagtcaatatgtttcttcctctaaaataatggcattttagtttcttatagttttgtgagggtgaagaagccctagatgttttctcttgcattattttcttcccttgccttggctttccgtttttattctccttcaaaaaagttttcatttttctctagatggtctcctaatgtgtctcctttcagacacatttgttagaatgatcttaacctgttctcccagacagcagagcttaacaaaaaagaccaatggctatttgttgaattttgaattttaatttttgtgggtacatagtaggtatacatatttatggggtacatgagctgttttgatacaggcatgtaatgcataataatcacatcatgtaaagtgagatatccatcccctcaagtatttatcctttgtgttacaaaaaatcaattatactttattggttattttaaaatgtaaaattaaattattattggccaggcatggtagctcacgcctgtaatcccagcactttgtgagactggggcgggcagatctcttgaggtcaggggtttgagactagcctggccaacatggtgaaaccccgtctctactaaaaatacaaaattagctgagcatggtggcgcaccagtaatcccagctacttgggaggccgaggcaggagaatcgcttgaacctgggaggcggaggctgcagtgagctgagatcacaccactgcactcagtctgggtgacagagcgaaactccatctaaataaatatatatatttatatatatatatatgactatagtcaccctgttgtaccatcaaatactagatcttattcattctttctattttttcacacccattaaccttccccacctacatctccatcctcctgactacccttgccagcctctgataaccatcgttctgctctctatctccatgagttcaattgttttgattttttagatcccacaagtaagtgagaatgcaatgtttttctttctgtgcctgggttattttacttagcataatgacttccctttccatccatgttgttgcagataacaggatttcattctttttttagggatgaatagtactccattgtgtataagtaccatactttctttatccattcacctgttgatggacacaagttgcttccaaatcttgaatattgtaaacagtgctgcaacaaacattggagtgtagatatctcttctatatactgatttcctttcttttcggtatatacccagcattgagcttgctggaacatacggtagctctatttttagttttttggggaacctctaaactgttctccatagtagttgaactaatttatcttcctaccaacagtatacaagagttctcttttttccacattctcaccagcattttttattgcctgtttattggataaagccattttaactggggagagatgatatctcattgtagttttgatttaaatttctttgacgatcaatgatgctgagcatctttttatatgcctgtttgccatttatttgtcttttttttgagaaatttctattaaaaccttttgcttatttttaatcagattattagatttttcctgtagaactgcttaaattccttgtatattctgcttattaatcccttgtcagatgggtaatttgcaggatgttgttttattaaggaatacaatcaaaaaagagaggatgaagaacagtggagtgaaggagagaagtgagaaaccaatgagatcaaattctattttgagtatgatattttggtatctccttaaatttttcatccaaagcaagtgcttcacacctcactcacctctccccagttacagccctgattgaggtgcattatcagtccagctgccagcaagtgcaagtggttgtctgattcaggaactctgttccctgagaagtgtagactgagtcttggaatcacccataagtggggagtaaagggtacctgtgtgaagatggtcaaaaatcatagagctatcataagaggcaagtgaatctaaggtgtgaaatggtgactaagatatgtaaaattagctcctcacacaactcagctacttgagtgtccaccattatatctagctctcataaaaaagataggaaaaaaaattgtgcttacttcttctctgatagagatgaagtaaatcaattattttcagagaagttcctttaaggtagtagccagctgcaccccctgaaaagttaatgcaagtgggctaggagatagactattgctcccatggctgtagctggtcctggggctgcaattgatctttgcgatctcccctttctaccacccagtctagattcccttcacccttagcaattctttgactggtctgagtggcttgtctcatggaatgatgcaaatcttcatttcagagttgtctaaagtattacatttttcagtgttctggggacgtggttactacattctcaattttgctttcaaaactagaggtagaagcatcaagtactgtcgctttgaatcccttgagtattatttgtctctgcccccattgttaagcagcaaccctgactctttatggtaatcatggaggttagcctcctctagtactgcaaccgctttatttgctcatagatccgctggcatgaaaagtactgtatgaaccagggaaggttgtagcttcaagtttaattggacccttaatatgttctctagcagaagcatttctctcctgggatacaggatctatagccctacatagccaaaagttgcagagatgggaagcatgactctacaagtgggtcattgagtggtggtaaaaggagccagtcttacttctatcttttggtttcaagacacaagtagtctaactaaagggacgtaggactatatactggccattgattcagtgcatgcactgcattctggaagtcaacaccttgaccccacagagtactcattttaagcttatactttaactgagattgtagcaggcaatttcatctgtctcttaggctgactgcatgtgggtgattgggtacctgaattccatgtacatgtaattattggtaaacttcctttgccgtaaattatgtcttttccagtgaagcaatgctatgtgcaatatcacattgatagttaaggtatatctttgcaaagtcatgctacatggtctctcccacccaggaaagaactctggaagaagggattactttcgataaggagaaatcacagctctccaggttgtaaaagttctgatgtaacttacctgccagtaaatggccagatggtattctcaagtaatgctgtcatagagagggctcaatgtaagtttttgctgctaataggttgtacattcagtagtgacaaatagataaatcttgtagagaaggagtctgtgttactaagtgtacttatgaaatttctgtctgctctcatggctactctattcatggtttcattatagcagtcctgagataatcaagaagaaatgctggctgccattcataggaagagtcttcctatttcctggtggtttggagctctgactttgggagaaattctccaatggatattaatatgtgacgcaaagattaaaatgttttgcatcagttcccataggtccaaccacaaaggccatctcgaggtgcccatccttgttttttcaatcttattcctttgaaacccatgttcaattaatcaagccatttcccaccacccaataatttatgcatatctatagtgaaggacacttctatataaactaggtgaccaaatttacagcccacaaccatgtcacctgagagcatttccctttcctactatgttttaggaggggagctgtcatgtgtcagcagtcaacttttagctagcaccaacatatcatcaatgagccaggccagagttctcttttccctatcattttgttgtaggaaatctcttatgagtcacgtgtgtgagaagagggtaaataaagtaggcattatgaaatttacctgttcatgtaatttactcatgctttctggacctactcaggcccagatctaaatatataatttcaccaaacaatggactactgctattctcacttaaactcatgcctcagcagatctgattgtactcaacttaaagggtgattccaattacatagtcaattagtattccacagccaagcattcattttttaaaatgtaattggtatttccgtgttacacatttttaagtatcagaataatgagtcctagggttcaccaagattctttttggtgaaaattttgtattcctttctggagccatggctgtaagcatatcaacaaaacataagatacagaagtaacagaaaatatggagtttatgtagccttttaaaaataagtgtggctagttttacaagtttaggctttgtgacattgtgtgaaactactcaaatagccatctaaataaaaggatgtgttttggattaagtttgaagatttatattaagattaaccaaatttcaagaagaaataaataatctgtatattataaaaatagaatgaaaataagaattagatcattttcagataaatttacacaaatcataaattagtttaaaaattttcagaaaatttaattgtagtatgattcttaacaaaattttgctaaaatatggttttgggtaataaccactttttatagaacagagcccagagattaaacagctatactacacagaaatggcataaacaccaaaaggaaaactttaaaaaatttacttcatgagatgactatatcgggtcttaaacatggcagataatccactcatcattcttaggcatgcagcctaccacacaactttgaaaaagaaacaccgcacaaggttgaggattataaaccagagcagccaggtgcccagaaggtcagtccttaccatgaggtggatatttcttctgtccttcttagttcctcccagctacttggccctaagcagaaagcatcagctctcctgtgcccgttggtactaacctctggctatagcccagccaggcaggtgttgcagatagaagagtattgctgcaggatcgactgtcccagaatctttgtccctacttcagtggggtagtgagcaaaatgtctttcaagaagtctgtgccaacttttactcctattgacagttcctgagaacacctgtcttaactgtttcctccctgacacagcttgccttaattcaagtctaagtgtgtatgtactttggcagtgcaggagaggatctaatccccacagctttgctttttgaggaagtaacctatttggggaatacatacaccatctccctggggtggaactcatttttctgtattagctgaaaatgctgcgggaggaggatttggctgcaattggagtctctctctctctctttctctctctctctctctctgtatacatatatatatgtacctttctatggctgtgaatgtactccccacaggaaaccaggctgtagctcctccccatttagaagcaaatgtgtattaaatgcttgtagcatgctttatattgatacaatatatttttgtatatcatgaggttttataagaacctcataatgtaggtcctgttgtcccattttttatatattggggaaaattgagtaatagatgaaacaatgtggagctatgatgtcatatagtcagtatgtggtgggaagctgggattcaaactcaagcctccagggctctgactcctcatcactgcacacagtggctcagagaaccatcgcggtgaacaggaatctgcattaacagctgctattacagcaggtttttaggaatattgctagttgcctactcaagagtatgataatattctcattcaagtctcatgcagaaaataaactaaaatatgtcaagttattttgtttggggtaaaataacttttttattttatgacaattagtaaagttaggtattctgtttactttgaatgttgagtgaaatacattcttaaatatttaaggaaataaaagatgatcttaaaaggcctattatggtgagaattatttcttaatttgatgctgcctttcctagaaaaacaatgtggtttgaataaacaacattttaattcatttttaagattaggaatctttctcttgttatggcaataaaatgctctaacagaattggaatgtgaaaaattttgaatgctatgccatgtaaatagtctctaataactttgagaagagttaataaaaaattatcagcttttcagttttgattaacatatcagtgaagtcttatctttttaacttggttttaagtattctacactggtgatgtagaagatcgcaaatggcagataaatagcacttgtcccatcatctccatctggcactcatatgagacattactaatcaatcatatgctctttcccattgaaactgaatgttatgtcagaaatttttcaagacagggctttcactagccactcttagttgactggagttagtataggtgtttactgtattccatctctgacttattttccatctctgacttaaacaatccactattatctctaccatagctaaaaaggaaatatttgttggttacttactatgttttatattctgtgctaaacaatggaaatagaataatttaaaaattaagatagtttttaaattcgtggtaggctgtcataagaaacaatcccttaactcaatgacttcaccaaataagtttgtcacttatgcaaagtgcattgcagatatcactggttgggtgactccatgaggcaactgtcctccaaggagagatccaagaactctggttccttctaacagtggtttttccattttcaaggtagctgggaaaaaccatagcacatttaaccacaatgtcggcctggaagtgacacaaatcacttttgtttatatccactggccagaaaaagtcacaccacctcaactaaatgcaaagaaactaggaaatgtagccactgactggacttccttttcctaaatgaaactgtggaaggaaggatagcctgaatattttaataggcaactagtcatctctgaaagaaatagtcatagtcccttactcatcagatttaccacctaataaactctttatttccaaaccgtgctgtttctcaagttcttcatctccagcagcatgtgccctataaaatctgtggtcatctctatgtatatataacattcatattatatatatatatattatttatacatatattcatctattcacaccaacatatacatacacacacactgcctaaatttgaaactgtccatcattctcaaattaacacaaatttatgaacttctcttttctgttattggcattcttatttttttacagctttactaatatagagctatttttggcttcttcgcaagcttttaaccaggtctatccaatctttaaataaaaattaagattatttttcagctgtgatttttaaatactttttctcaattctcctgaatctacttcaatctgaaattatcatggccccttctctaaaggggatttctcatttccaactaataccttttttattactggcacatttagctccccatgactaattctaacatatcttatactaaaaacattctttatttatttaatgaatgccaacattttatcttgtaaagacatgcagcagcatgatgcatttcatgtatttttacttagctgaacactggctttgtgggagtagttctccagctgtttgtggtctgtttttttgtatgaacacatcactctttatttcctctgtgtgaattttgaaggctgaagcaaaagattcttcacccaaaaatcacattctttatcaacacctcccaggctcttcacaattaatgctggaataactggatatccacatacagaagaatgaaatcggaccattatcttacaccatatacaaaaatgaactcaatttgaatgaaagacttgaagataagacctgaaactgtaaaaccactagaagaaaatttagaggaaagctccataacattagtctaggcaaaaatttcttggatatgacaccaaaatcacaggcaagaaaagcaaatatagacaaatgggactacattaaacaaaagaaaacatttaacagagtaaaaaggaaacctacacaatggaggaaaatatatgtaaaccatacatctaaaaatcagttaatataaaaaatctacaaggaactcatacaactcaatagcaaaaaaaacaaataacccacttaaaaagtgtgtgaagggcttgaatagacatttttccaaagaagacttacaaatggctgtcagggacacgaaaaaatgctcaacatcagtaatcatcagggaaatgcaaaccaaaattaaaacaaaaaatattatctcacacctgttcagatggctgttatcaaaaatcccaaaaacataacaagtatttaaaagacaatttagaactcttgtacactattgatgggagtataaagtaatgtagccactagtaaaacagtatgcagtgtccttagaaaattaaatatagaaatatggtatgatccagcaataccacttctgtgtacttatccaaaagaactgaaattggaatcttgaagacatatttgcactctattagttgcatttacaatagtcaaaatatggaaacaatctaaatgtccactgacagatgaatagatacagaaactatgatgtgtacatacaatgaattattattcaaccttaaaaaagaagcaaatcctgccatatctgacaacatggatcaaccttgaggacattatgttaagggaaataagccagatacagaaggacaaatactccatgattccacttatatgaggttatatcaaagtcataaaaacagagagtagaataatgatttccagggtctgaatgggaggagaaatggggagttgctattcaacaggtataaagtttcagttaggcaagattaacttttagagatctattgttcaacattgtgtctatagttaacaatatgcaccatacacttaaaaatttgttgagggtatgtctcatattatgtactcttatcacaattttaaaacaaggaaaagcctcccagggagggaaaattattcaatactttcattgtctaatatgataaatgtgagccacatgcattggagtaaacaagatacattattaaaattaattttatgtctttttcaatgtacctgctacaaaactcaaagttacatgatatttacattatatatctgttgcacaacaccacactggaggagatcttttgcaagtatgaataaatacacttaatcttatagactttgggttaaataagggtcttgtggaattaaatttgctgttatttgacttgtagtcagctaaaggaatgtattctattttctctatttttagttgtagttcctgatgggtttaataatgaaaacaaacttgtatatatgctgagagagtagttaatttggctagaaaaattattttttaaagaatgataaattgatgcagtggttatcttagaatgaatgctttcttcaaaatacaagcgttgacattcaatgtgacctttagtgtcttgcatgctttgtttagtagcttgttttgctctagtatcctctgcacgttccatgtctgtcttacttgtatgatgttatcttaaaatctgttatcctttacagttaaataaactatggagtccaatattttaattttatcagatgttaggatatttcttcagaatagaacatacatttaacatcctgtctactttaatggatttgattgattgaatggttgtattcaaaagtttttcacactcttcaaaaatttatttatattataatgagcaattatcaagtgcattttggtgagactggaaatgtcaagtcaatagcggttcaagtctttgggagtctatattaaaaatcttggcattgagaaaggataatgagaacagggaaatctaccattggtgacaacagtgacttaattaccttagttttcaatttcataaggataagaggaatgcatgaaaaatttgacaatgggtattttaaagaagtctttctttcctgatgtgagccttaccagaaaatcactccactaatcattaaagtaaggtgtaattttttaaaagctagttacttcagaatatgaatatagaataagaatctgcttcttcaaaggccaaacagcatcatcttaaactactggagtatttatgaaaactcaatagtggcttgtaactatttctatggtggtggacacatttaactttaaagtagccatttgcctgtggggatgttaccctttgaaaacattttccttgcagtgcagaatttctgattagccatttaaccttggaagaccatgtatctgcagtgctttcccaaacttgctccattttcctcttgattccttgtgtataattgggtggagcctatttcattaattaagagttttagtaaaaaaaaggctgaagtgaatatatagtggagacattgcataggagcaatgctgaagtttctgactttagttttccttttttttcccccagttcgtttgttgagttgttttattctttattagatttatccatgtcaagttgttatctcagaagcgcctggctagcaggaagaaattatgtgctacccacatcagctagcttggccactatgtggataaggtggaaacatgggtaatatcacactggatccttggtaagcacctgtagatcacaggacactcccatgctggggactgttgtataaggtgatacccatagagcagcaccttcatgtttgagctagtggcagtgttactgtcaatcaaagcctgtcagagggagctcaagatggccaatgggcccatttctcaatccagagaaagctacaaatacaggcttttgatattgtctgtaaaagagattactttcttgtcaaaattactaacaggttaactgtaaatttaaatatatcacaatttttggaaacctgttttattatggcattgaaacaaaatattacaagagactcaaaaactggaagtattctggacttctccatgtgtttatgaggccttgctattcaccagtgaaagagtagctgagatcctctgctgagcaaaagcttctgaggctatgatgtggactcagatcctgggtcccctactgtctgactgtggtcatctgtcaggttcagtttcctcacatgaagtgtagttaattacactttaaaaaatgttctgaaagaaaattgagataatgtgtattagcttactgggaagtattaggtacaaaataaccataagctaataatatcactaacagacatgatttattagtaaatcttctactcatagagcatgtctctgtgtacaaagcttgctaccttaggttcttcctacaagtgtcatgttttctgtggcattttcaagaataaattatatttttataattcttaaatttgtttttaatttttatgcatacatagaagttgtacacattatagggtacatgtgttatttttctataagcataccatgtgtaatgatcaaatctgggtaattgtaatatttcataacctgaaacaattatcatgtctttgtactggaaacattacatattttctcttctagctatgttaaaatatacaataaattatgttaaccatagtttccctattgtgctactgaacattagattttatttcttctatctaactgtatttttgaacccattaaccaacctgttttcaccccccacttgccattacccttcccagcctctgtcaaccaccattctattaactatctccaggagattattttttttagcttctacgtgtgcatgagaaaatgcaatatttgtctttctgtggctggcttatttcattaaaataacgtcctacagtttcatccatgttgctgcaaattataggatttcaatcttttttacagctgaatgatattccattgtgtatatatgccatgttttctttattcattcatccattgaagggcacataagttgattccatatcttgactattgtgaatggttcttcaataaacatgagagtgcaggtgtctcttcaatatattgatttcctttcttttgaatacgtacccagaagtgagattgctagctcatatggtagttctacttttagttttttgaaaaacctccatatgagttttcacagtgactgactgcagtaatttgtataatctccaacagtgttcaagtgttcccctttctcagcatcttcaccagcatttatcatctttttgactttttgataatagtcattctaactcgggtgagataatatctcattttggttttgatttgcagtcccctggtgactagtgatgttgagcattttttcatataccaggttgtcatttacatgtcttcttttgagaaatgtccatttagcacttttgctcattttaaaatcatgttatttgtttatttgttattgagttgtttggttattaataccctttcagatatttttgcaaatatcttcacctcttctgtgggttttctcttcacttattaattgtttcctttgctgtagagaagctttttagcttgatgaaatcttgtttgtcaacttttactttggttgcctgtgcttttgaggtcttacagaaaaaaatatttgcccaaatcaatgatctggagcatttgttcaatgttttcttctagtagtttcatagtttccattcttagatttgagtctttaatccatgttgatttgatttttgtaatatggtgagacataggggtctagcttcattcttctgcatatggatatccagttcttccagcttatttattgaagagactgccttttccccattgtatgttcttggttacttggtggaaaattagctggctgtaaatgtctaattgctctggctaggacatccagtactatgttgaataaaagtagtgaaagtgggcatacttgtctcgttccattcacagtgacgcttgctataggtttgtcatatatggcctttattgttttgaggtatatttcttctacacccactttgttgagagtttttatcatgaagtgtgttgaattttatcaaatgctctttctagaatttattgaatgttcatatggtttttgtacttgattctattaatgtgatttattacagttcttatttctgtatattgaaccatccttggatccctgagatgaatcccacctgatcaagaagaatgatctttttaataggttattgacttcagtttgctgaggatttttgcatgaatgttcatcactgatattggcctatagttttatttgtctagttttgatattaaggtaatggtggtcttgtagaattagtttggaagttttcctccatccctattgttttggcatagtttgagtagaattagtattattcgaggatctactttctgccacttttgtctaatagtgcaccaccgtggagctggaagcattaatgtttcacatcagcacagttactacatctaggatactccagtctttgtgcactgaagctgcactagcaactgcaaccaattttttaattatttttttattgtgataaatatatacgtaacatagaatttactattataatcattttaagtgtattgtttagtggtattaaattcatttataatgttgtgcagccaccatcaccaccatccgtctccataactctttctatcttgtaaaactgaaacagtatacccattgaacattaactttccattctcccaacctttatcccctggaaacaactttcactttctctgtgattttcattatgatttttactactgtaagtacctcatataagtgaatcatacagtatttgcctctttgtgacttgcttatttcacataacatgatgttctcaaagctcatccatgctgtagcatgtatcagaatttcttcccccttttaaggctgaataatatcccattttataggtacattgcattttgcttatacattcatctattgatggacacttgggttgctttcatattgtagttattgtgaataatactgctgtgatattattcatagcaatattatttatatatactctctgagatacatacatatatattgtggtgtgtgtgtgtgtgtgtgtgtgtgtgtgtgtgtgtgtgtggatgggtgtgtatttgagaccctgctttcaatattttggatatgtatccagaagtggaattgctggattttatgatactatcatttttaatgttttgatgaaccgcaatactgttttccacagtggctataccatttgcattctcaccagtagtgcataagggttctaatttattcacattctcatgccttcatttttcacacattcttaaaggaagtcaaaataagaactttgcatttaagggtagacatttttctgaagtgagggggtagatgttaaaatttactttaattgggaatatgagaacagggctataaatgggttatgaaaatcaacccagatgattaaaatacaatgcagtaatgtgagtaagttctactctttgtggtatgagtagtatgtatgaagatggtggtctccacataaagggagctgtttttaaaaacaggcagcttggaaagcatcataaaaatggaaattcacatagatgttcaatcattagtaagcttcttttagaccctgaaaaagcaggaaagtattataggcatagggtccaaaataagtacagatgggatgaatctagtttaccaagaaatggcaaagcatttggacttaggagaaagtttgttagaaagagagggagagaaagcacttatagcattttacaaatatgtttacagttttgtattttatattaatattacttggaaaccatttttccttttattaggtaaatgatttttgtcacatccaaagatagtctgaatcaaagatttatatcttgttggatttcttttattctagtcattagtcaggctgcattcttttaaagtagatgttctaaaattataaaaactaaattctctaaatgtatttaacaaagaactctcatttaacaaagatcctaacaaagacccaagatgaacatcatgattctttcacttatatttctacttttttggttaaatatagcttgtttttacaataaacatatatagcaatttttttctgttagccattttttcttatttgcccaaagttctggctgaacccatttgtgctaatttgactaaggtatatgaccgatagtaaaccaatattatatttgaaatcataaatgtggaaatgggaatgatgtggaaattcatgtaaaagctttttttgatgaatagaattaaactttaacaaaatgaaccaaataacatctttgtgtttgttcttgcccaaggcttgtatctcaaaagcgttattgctgtagcaattgattttcttgtattttaaaatagcaaaggatttttaaaaatgtttttaggtaacctgaaaaaaagaaggtgatttattttctgctaagtcttgttaccagtcggtagtaacaagaactgtaaaagttccttagagaatgcttaattatcttttgagatgctctcaggagaactgaagagaagcttataaaaaggaaaaaaaaaaaaaaaagctttttctaagaactgttttcacccaattaaactataactgatttgtggttagcccatgtcataagcctttaggttttgtaggaaataagggagaatcattcttagcaaaagaaataaaatacacaataggaaattaatggagaaccaaacagttgactatgtggatttatcctcaaaatgtttctaatttgatcattcctttttataatctctcaatttgcttctccttaaaaaatagaaaaatcactcaaaataatctataaaaatgcacaaaaaggtctctgatgttatgaaaatactaaaggaaaatagaatcattatgatgattcttcacaagtctgaaatcatcagagactaaagaatccctgcagaagtgattttatttaatttcccagctgaatactgcctttccagtggagaagatcttctcctaagaactcttttataatttggaggaacttcaagaaatgaggatgcatctctttcagccaaaattatttgtttacaacttgagaataattttaatgaattacttctgcattagcagagaggattgtagaatggtttaggtttgtgactcagaaaaccctctgtgatattgatgtgacttaagggtttatgcatcaaattaatctgtgacaaaaactgtacaatagcatgatatttgatgtctgtcataatattgcacattatttcatgttgtctttgatctttcctgagcctgtatcagggaaatcactatctaaagtgtaatgtgctatggaagagatgcatcccagtctaaaccccttagcctggatcatggaaattaaattttgaatgtagatttcatatttgcttcaaacatttacctatttctcaacctgaacatgaagtaatgagtctaagaacaggagactgttttttcccttggtattggacacttcattgagaagatcactatgcatttcacactaccttattcctactgatcccaaagcagggctttcgtatttgatcagtgctcagtagtattcactacaccaaagccctatgtccctaccagccatttggtatgtctgaaccaaggaagtgaatctgtgtcattccaaggcacatgagagccacacttgaagtagtttgttgtcctcttaaccccaaaagggataatctttaattaattactttgccaaagcattttatgtttgtaaatgtttaataaatgtcctggcacttttaaaaatgatttaaatatttttgccactttttgattcaaataaaactgtaataatttcagttcaatgcaactgaaaatatagtgtcattaaaggatatttactgctaaattccaaatctcaggtttgcgagccatctctgggcagaagcatcaattcttactaagtttattacctcaagttattatcaatcttgtggtggtaggtggggaacaaaaatgatcagctcacagaatttggttaagaaaggaaaaaaacgaaaacaatgcaaatgacaggtagttacagatattagtaaaataaaaatacaatctcaagtatcagtttcttaaattaatagaaaaaaatacaagcaaagttacaacaattattattatgccagatatgggatctgggtaagttatttgcattttatagtgatttcttaagcctcatgtccactgagacggttttacaaagctctattagaaatagaaatttagatatctattacactttatcagacggtgggatttttccctaagcaagttctgtgtccagattattataggttgatgcaagagtaattgaggtttttgccgttgcttttaacagcaaaaaccgcaattaatttgcaccaacctaataatttaaattttatttgacattaaatttagttatttaaattaattggattaagaggagttggaaacttccctggcataaatatctatagctacccctttctgtggtttttagaactaagtccatagctaaggaatctgaaagtcaggcaagggcatgtaatagataccttaacatcttgtcagccttttgttcctttgattttcagccttcagtccatccatccaccatatctttattaagcattcactaagagcagcagtcagctgagtcctgggcacacagatatgagcatggcagataaaccgtttgtcctcatggagcttgtagtctgtgtgagcctgatgctgagcatgccaaagagaaaacgacaagatccagggaaggaaggcacataaaacaaataattacagcctgagagaagtagtctgatggagacttgtattgacattgcagaggaagagcaccactcttcttaagactgtccatgaagttgtccttcgggaggtagcatttgagctgagtcacaaagttgagcagcatttagacactgctgccatcactaagtgatgcaagtctcaacctcatttctccttcattcaacagttatgaggagcttagagtaatcagggaacaattcctggatgcagtggcattgcaggaggcagaaatatgattgcaaggcttttcagccctgagaaggtcctgcgaggcaggaggatcgttttctttgaactcaggaggactggattccggatgttatcagaccagcgtttatcttaagataaatcagggtgtaaggaacccaataatgtatgattttagggaaattttaggaaaagactgctttttctcttccaagtatctgtcccttcctctgacacagggaattaaacaaattacatcatgatcaaggcattccttctaataaagtcttcaaactttacctaaaggagatgccactgtattaatgctaggattttcccaaatgtcttttgaaaggcacacatcctgcatatgtttgtgatttgaaaaaaatggtttcataataattaaatctgggaaacactgcaatctatagacctctcctgaaaattaactatgcacttgtaaattaaggagcataggagtcctgtggttaaaaaataagttaactgacctttgaacacctctcccccttgagtttttgcagaacatctattatgctgaaagagctttgaggcacatcaatcatttttaaacagcaagataagctccctttcctgagctggagaacactgagctctaactggtggatggagggatggaagatcagacagggagaaacagaggaggacaggagaagagggtggaaataaggaggagattttggataagtggacaattttctggtcagcgctgacacctctagctgagagatgacacttcatgtcctaaaatgcttccccctgttttgctgtcatttgtggccacattcagctactgaaagtgtgaggactttaaagggtctcagggctagacgttctgatggttcaaggcacttcctcctgggggcctaataaccagtttctgactcatagcagcatcagattctgacacctgaaggttatggacacaataaaatctctccagcatgagcttccgtgtactcttaccaaaaaccacacgctgacagaattagtatgtggagccagggggactgaattgctgggcaatgggtcatactaaaaataaaaagatgtaatctacttaagtagatatacgaagccaagaaataatttcaacccttttcaaaattcaatcctttgccatatctttacaaacaaacgaaggggagttgttgctaaaaaatcactatgctaatttttagtcacattcatgcctgtgagcacgtataaggagttccaagataaattttaccttctttagccttgttaaaatgcttagaaattaatatgcattgttatccaagattatgaagtgatatatgttctttggaaatataaaaaattaagatataaaatacaaaagttattataaataacattttgatgtacattattttagtttgttccccaagatgtacatctaagtattcataagttttttaaacctcatgtctacttcagtatacctattttgtagacaaaatctgttttgtagattttcttcattcaaaaatgtaaagacaacatttctttagccattaaatattctacacagtatgcctttatatgagtatacaatgctttaacacaattaattgtactctatttcattcccaatgttttcatattctgacttttaaatctttttgtttgcctttgatatttttactcaaagtaaatccctaaaggcaaattgccgtgtcacagtatgtgaacatttttaaaactataacaagttgtcagactgctctcaaatattatatatcttacaggtctctcaggggctaggtggaagaggcagtatttctctattctcactaataaatgaggattttaaagtgccaacaatagttctttaaataagtcttcttccacttgtattttaccgcaaatgttactgactgttttctaattaaggtaaccaggtgaagcctttcttggtcctgtgtgtggctgaaatcagggctgaaaattatacatgaagctattttttaagaaaactctaaactctacagacatcttttatttatttaatagtgcttaacattgcaactttgaatgagacagagtaaagctgtcacattttttcttgtcagtttaagtggttataaaacagctgtgatcaccagcttaatgaatgtagaaattttacattaactgtggatagatatccatcttcctcttctttttattagttattaagtacataataaagtaatatgtaaacacatagaaattagagaccatcttctttttcagaaagcctagttttgctcacttaattaggagttgttatttgatgacaattttttaaaaaataatgatgttataaatgtcaaatagctttttatgcattacggaatcagacattcactttgttgtggagtcaatgtgatgtcctaggttaaggaagaagtgcatttttcatgtttctcaaaagtactggacttcgcacaagtaaaagtaagaaattaaaatccatacaaagtgaaaaactgtaactgtaatgtgcgggacacaccaaaaagagggtggcatattaaaatgaaataaaaaatcattcatatttaagtctaaagaaaatgggccaaagtcaatgaaagattgtttagattcttcagcacattgttttcctaatcacattgtttaattacctgaggttaaaatatagacgaatgtattagcaaggagagatgcaatgattaaagactggtactattagttgtgagattttcaaggacatccttatgaacagaggtagaatagattttttttgacacagagaggctaaaagtatatgaaaagtcctgagaccattagtgatctataatatctcaaagaataaccactgaaacaagaaaataggtacaactagcttatctgaatctaccttaaggaatcatcataaaatatctcccaaatagaaacgtaaggctttatcacaaatagttaacataaacgttaacacggatagttaaatgaagtaaaattaagtttttccaaataaatttctcaggtttacagacagcacagtatttagatgtcttatttacacaatgcctccattttagctacagatgtggacatcctcaaaggttgactgaagactggtcagtgctattctgtcatttccaggaatgacttatagatgctgaggcataagtcctcctgtcttgccatgcaaggaaagggctatgaaattttaagttatgggtgctacggagagcaataaaaacaacattttagaattattcaggtaatgcttaggacctgtgaacttagaaatatatgatggcaaaaataattaccacggtgagcatttacaaatgaaaaaaaatcactttaatacccaaatagaggaattgggtaaatatatgatgatccttcttcccaatggaatcaacacagttaattagattgaaatttaaagagaatttgtgatagcttgggaaactgctattaaaggagcagtcaacgatggaaaaattaaaaataattttaaaattttcttatttctaaaacagctgaaagaaaatatagcagaggtttaacgttatttgatttgctgttcatgaaccctgtgtgttattcttactttcccacatttatgattttgcaaattttctctcataaacctatattaattatttccataatacaacccacccttattttaaactgtactgtgggtcccatgagcaatgcgcagagcggggcagctgtgcagcttccaagagaaggggctgcgcctggctccacactcctcttctgggctgctttgctatcccagctgccctctcgtcccttcctatcagcctcttgtctgtgctgctttctgcaagttttacatttttctttgtaaatttttcacaggtaaaggacctatctttatctgaaggagagaataaaatcaatctttgctttctctttgtttatattttgtgtgagaaatttgtatgctaaaatcaaatgccaccggtattcacaaatagggtgacatttgtgttgtgcctgattacactgtgagccccactcaccctctctgtggctcctgggggcacttgtgagtgcatctgtcacctggaatcacctcaggttccctaccgtgttacctctctcctgctctggctcccactcgtaagggacatcagtagggccggtgtcatgaatagccactatttttttttctttgagaaggaggctcactctgtcatccaggctggagtgcagtggcaaaatctcagttcactgcaacctacacctcttgggttcaagagattctcctgcctcagcctctcaagtagctgggactacaggtgtgtgccaccatgcccagccaatttttgtactttttggtggagatggggtttcaccatgttacccaggctggtcttgaactcctgatctcaagtgatctgcctgtcttggcctcccagagtgttgggattacaggtgcgagccactgagcctggccaggaacagccactattaaaatgccaatgttcattctcaagagctcagatatcctcacaggggctgattgatggccaggtgcaggagcaatgctggtgttgggaaactggaagaggccactgtggctagaccatagaaagtaagtagagcatgacacaactttagactggagagtcaggtggggcaaattaggcaagacctcctaggccaagctaaagatgttaggctttatccaaggatcaccagatagctcttgaaatattttaagcaggaaagagcgatatgatctgatgtgaaaagtaaatgatgatgctggatatggtccacattggcacaactggtgagagatgaacaagggtatgagcctgagtcctctggattaggaaataaggaatctgtccacaactacagggaagactctggtaagtgcaacttacagtttacaaattttaagagaggtgccacatttgaagagactgttaggacaattactatgcagctccagtttctctgctagcataattttgatcccagccaacccatgcttttctgtcttaaaaagaccaaatttagcaggtgtttgagcctggaagcaagaaagcaagttaaaaataccaacatcattttggctaaggaatagatttcctttaagtgtctctgcacttaagcattcatcctgagtaaaaaaatgtatccagcacacagattgttccctctcatgttactttctatgtcagacttagcaatctcaacactccatccaatctaattcagaatcattaacatttgtacttagccacatggattcaaatgctgaatgtttggaacatttacagacagatgttatcaaagatgttctcttttcacagtttcctctgttaatttgcatagaacaaccattgccactgaacatgaggtgcagtcaacagagaagcaatttttttgttgttgtttgcttgctgttgggttctgggcatgtgcttgtattgggaaagtgttgtactttactgcatttaaataagtattacttcaattatggtttgttgttgctgtgtttatagatttactttaatcggttaggaagcagatattaatatgaggagaatgtgttttcctgtagatgctgattttaatagaaagacattcaggacccactttttcattgaattctgcctttctttttagccaaaattgggtcctttgcttttactaaaaggtgcgttttatttactcctttttgcaattccaaggttgggtagttttgaattaggaaaacatcattacctctaacattgatttgtcagagtcttcttatttacctttcatactgaacactaaaaggacctagaaaataaataacaaagtccaacccaaactaaaggtgcccttcatgtgtgaattttatgacttctctgctcttgttcataaattattaccaatcaaaggattcttgtccaagcttcactggggatgaaaagctggtcaagattcagacaaaatttgctgctgaaatgagagcatttttgttagtagatatggaaagaatcaatttaaccaatatattagcacgtatgtcacttttcctcagtcttagaaaataaaagttccctcctcttgtcataggtcatcatgtctaactctgctcttcatcagatctttcccatttccttcattgccattatatgtccttcatcttgaaacactggctagtgtccctgcgacctgtgtacatgttgattctcaagtttttgttaccaaaaaacccaaatctcttgctcttcattaactctctaacgaccatactcactcccctccttccttctttttcttcttcttctttatttttttttttcttcaagagagagctaacgactgtgaaatacagatgtcaatgaaagaccttggcatgcagtgttccagaaagattaatgtagccatgggctgccagaggcaagtagatctgttttctggctattgcaagagtttattcagtgcagggtgatgaatgtctgctcaaagctgctgttccgaatatcctaatttgtttcgactgccatggttttttcaaattttatcctcaaaatcatcctcaatgcggaacctgtcttgtgctgccatgttacccgcctccattttgaaggcttcatctggtgctacttaatcaacattcaccttggttttttgttttatttgtttgctatcctatttctactttgttttacctcttgcttttcatgacatctatagttttgaatataaatattctccaggaatattaggtcttattgattcaaagggctaagctttttattatttttaaagaagtaggagataatattactgattttaagagataatatgctatttttactactatatagctgtgggattttgttttattttattttgtttttcggtatgccttcatatctgataagatcagctgtttttcctaagtcttcattatagatgtctttgaaaagaattaacatctttacaatgttgaattgtctatcagggaaaagagtgtaactttatttcttcaagtttttatatctgtaagtggaattactaaagcttgaaaatctaaaatattctctataatgtcttgtgcattgtttacacaactattattgtaattcctaaatattttatcttgtgagttttaatattatcttatttttaattttattttttacttgattatgcctggtataggtaaatttttgaaaattaatctcatatcaaacaacttcccagaactaccttataatttttaagaatgtgcctgttaactacattagatttgctttgtagatgaacatatattggtaattaataatttttatctattcctattattttattttcttattacattttctaggatctttagtacaatatagaaaaaaatcaaatctaattaaaaacattgataagaaacatctttatctcatcccctcctttaaaaaatatgtaccaaatcaccccattgtgttgtgtggggttttgataaattctccttatcaagttaagggatttctctgtacttttaagtttcccagactttgattatcagactgaatttcatccccctttttttgcatttgggaaaatcatatacatttgtctattattttgttaatttgatgacttgtattgatagatgttctgatattaaatcattatattctctattgaacatgatatatttttgtaaattgttgagatataaaagctaatttaattaatctggatttttttcacacctgagaaatgcctatacaattttctgtttttagttatccagtttagcttatctgttccttgaaagcttgctagaattctttgtaaaactatcagagccttgtactattttggtggaaaggaatatatttaatttatatttcaatttttaatagtcattgtctattcattaggctaatattactagttttggcattttatatttttctagaaatgtattctgttttagatttctaaatttattggcatatggatgcacaaaacagtagtttattattatagcattaatacctggagatatttccctttcaaattctataatatatttatttggtctattgccctcccatagacactgaaaaataagtattaacagaggttatctaacttttagtattttcaaataatcaatttttggtttcctcatctttttgactggttaatgtttcttttttatttcactgattgctgcctttaatttttttattttctttttatttttggctttattatagtattttttatgttttttataatatctaacttgttttcacttcctcttgtggtctgatagatccattgaaagctgtaatttttccataaatttcttgattgagctatgccctcaattgttgatatataggtttttaattgtcacttagctctaaattgttccttattcccccataccattaccattttgacccaagttcatctggtcataagtgttttaggatacaaatatgtccatttttaactattttcttcattgatctaattatttttcacttgatcagtgaaaaatatatcatacataatatgtatgatattgatgttttgaagtttattgaggcttcctttgagagttcattcagcattgacttttgtgtatattccatgtgtacttaacatgtcttttctccttgtctgatataaaattaggcatatatctattaagtttatgagccatcttattcaaaagttctagaatttttcttattcttttttctttatcagtttctaagttttctcttttaaaatcccaatcacaattgttcatgaacaattgtttatgaatctatttttcctatagatgtgatgatttctgcttttttgtatttcaagtatagatagactcataatatgattattatggacttttcacttattatctttcgtagtattatatattgtccttcattgctgctttcaatttacttgttgtcctactttgtattttaactgatattttatttattttattttattttttgagacaaagtctcactctgtcacccaggctggagtacagtggcacaatctcggctcactgcaacgtccaccttccggattcaagagattctcctgcctcagcctcccgagtagctgggactagaggtgcgagccaccatgccaggctaattttatatttttagttcagaaagggtttcaccatcttggccaggctagtcttgaactcctggcctcaagcgatccacctgcctcagcctcccaaagtgctgggatttattggggtgcgtgagtcaccatgcccagccttgactggtattttaactgccaccacaattgtcaattagttattattattttcttattttataatttttctcttctctttctttttgattttttctgcatctttttgccactaatatgtatatctcataggtaatattttagaacaatttctaaaaattcattcttacagaaataattttttgttgtaaactatgctccaagcagtcttgtaagcactttgcctgtatcatctcatttcatttatataaagctctaacaggcattactgttagcgttactttatatataaaaaacagccagtggaattttaaatagcttgcctaaagataaacagttaatggttccaatacttgaacctgagcctatactctttaccactatgacgtgctgccttctaataaatttataatgcctttttattgatatgtaatacatgtacatatttttgggatacaagtgataatttcataatttatataatatataatatgtgaaggacaaatcagggtaattgagatatccatcaccttaaaattttatcttttctttatgctagtaaccttcaaatcattatcttctagctactttgaaatgtacaattgattaatattagctatagtcaccatactgatctattgaacactagaccttatttcttcttcctaactgtgtatttgtacccactaatcaacatctctttatccctcctccccacctcttgtaacaaccaatctactctctatctccatgaaatccacttttttagcttccacctgtgactgagaacatgcagtattcatctgtgtttctcttaataaagtcactcccagctctatccatgttgctaaaaatgataggatttcattattttgtatgtcttagtaatattccattaggtatatatacaccacattttctttatccattaatggacaattaccttgattccatattttggctattgtaaatagtgccaatcatgggagtgcaggtatctcttcaatatatttatttcctttctctcaaatatacacccaataacaaaattgctgaatcatgtgatagttctattttcagtttatgaaaaacctccatacacttttccttagtggctgtactaatttatataacccccacaatgtactagtgttctgccttctccacattcttaccagcatccattattccctgtcttttctgataaaacccattttaaccgtggtgagatgatatctcattggagtttggatttgcattttccttttcttctttttttttgacagagtctcgctctgtcaccaggctggagtgcagtggcactatcttggctcactgcaacctctgtctcctaggttcaagtgatcctcctgcctcagcctcccaagtagctaggactacaggcatgcaccaccatgcccaggtaatttttgtatttttaatagagacggggtttcaccatgttggccaggatggtctcaatctcttgaccttgtgatccgcgcacctcagcctcccaaagtgctgggattacaggcatgagccaccacgcccaaccttgacttgcatttttctgatggtgaatgattttgagtcttttccatatacctgttggccatctacgtgtcttttttttttttggttgagaaatatctattcagatcttttgcccattttaacatcaattttcttggttttttgctgttcagttgtttgagctccttatattatacccatttttcttataaggaaattgagcctcaggttaaataaaattgcccacacaataaatgctggggctggactttgaacctaatcaatttggttcttgagtgtacactcccaactattttctgtttacttcttatattatacagttatacagaagtgagaaggtgaaatacaagttggggaggcaccaagacatcaaaggaatgaagcacaagatgcaagttcagaatatagtagtagagatggtgagagtttcattctgtattggtcctctctgtcctcactccttgttctcctctccttaggcattctggttttctatatggttttctcttaccccatcaaaaatctaccttcaaaataggagcagcaaaatccattcatattgaagtctggggactgggagttagttatttcttctgggtctaatggtaagagaacacattagaggaaaattttagattccagagtatttcaggcatatagagattatgtttgttaagcacgaaactcatagattacaaaataatacatttaaagaggtgagtaaagaaaatgccatggtagcagtttagagtggcaagaaatgatggtgttatgaagtcatagcaattgtaacttgttatagacactaacgattaaatatcctgaaacatcttctgttctaacttgagtgaaaatgcccatttattcacttgccaattttaggattcaacctgaagccaaataagaaactaagaaatcccttttaatagttgataagtcagctaattgaagtttatgtggagtggttgtagagtcttcctcaataataacacaaagaagagatcttagcatatgatcagacacgattataacactgaaggaagagttagtgttgttaaaattccatatgatatatagcattaatatcttgacatatggctggttttttttagttttcaacaaaaatagcaataaataatttaaatatatgtcaaaattaattattaagccttgtgtaatgagcgccatttttaaaacacacatttttattgtggcaaaatatgcataacctacaatttacaattttaaccatttttaagtgtacactccattggcactaaatacattcacattattgttccatcattgtctctaacctccagaactttttcatcattccaaactgaaactctatgtccattaaacaataactccatattcccccagaaccctaccaaccttggtaaacatcattctactttctatctgtatggatttgactacgtcaggtacctcatataggtggaatcctacaatatttgtcctcttgtgcctggcatattttattcagcgtgatatcttcaaggttgtagaatgtgtcagaatttccttcattttcagggttaagtcatattccgctgtatgtatatgtatcacttttggtaatccattcacatgttgatggacatctaagttgtttccactttttggctattgtgactaatgctgttaaaaacattggtgtgcaaagctttcatgtatatctatatatgatttgagtacctaaaacaaaatcttttagataagacaaactaataagacattagaaatctaatacttggtgttaactgggatgccatacctggtgaaatttttgaatcatttgtaagtatccgttatagagtgaccacacaatttatcatccaaaccaggatagtcttgacaataaaaataatatgactaatatttacctagacaaaatcggcacaaaacagaactatcccaggcaaaccaggtcatgtggccaccttatccctttgaaaggcagtttaataaatagaatcttttgtttccaggtactggaatctgtcatttgaaaatattgtatttaatttcactggaaattgtggtcaaattttcagattaggaagtgtattagtagttttaaacctctgggattccatttagtgagatgaagtcaaacccgtctatttcccttaagttaaccatttaatactgtcctttgatattatttaaagaaatgataattattaacagaggtggcaccaagcgataggtctaggtgaacccattgttttctattgctagcacttttgtcagtaattatctcagattctccatgagaagagaataattggacacaataaaaatgaattttgtactttgggttcttttctttctctgacataggtccaaccaaccaatgcatatagttaatcacttctaaagggaattaattttgtctggatctcaagacttttcccttcattcatcagaagcagaaattcagacattctggcatcccattgatcctggtagcaaattagatccccccttccttggatatccaaagtctagggggacactgattatatctatgtaattagtacttcaaggccaaatggaaatagaagaaagaaccaagccccaacaattttattcctttgataaattatcaaggtaggtgggaaactgtttagataagtgggatgtttgaaatctaaaacctttatctgagtacttgattaacactttgtttgttgggggaatagagagtattaggtgtaactgcgccaaaggaaaggaaatcaccttgataaatcaacataagggagaaagctaggttggatttaagtagccattcagttaataattaggtataatttataatgaacaaattgattgttttatatattatagttcactctctttgctctgacatatgccacatttatgtctcagatgagtttttttgaaaaaatagatccctttgttatagaaccccataaagaagcaaattagtgtttccgcagaggaacatatcagaattctcacaaggaggacagagactacaaagagcttcttttcaggttaggccagattttgcagacaaataagggagtaccaatattacggaaaacttttagttttcagtaattttagatttcagatatgtagatgagagattgaaggcctatgatggtatttatttttagatttataaagataatatataaaaataatagtaacatattgtagagcttctagaaaatccaaaaaaaaaaaaagataaaaagaaaaatcacctgcctttcagagaatgctttctagctgtttggatctctcttttttaacataattgagattgtacaatacatgcagtctcacagtttgctttattctgttaacatcagatattctaaagggtatttttgaaacaaactcattagaaaaactgacagaaagacagcagacctagaagaggcagctctgctagtcaataatggaagatgtggaagactattgctacaagaatttctgagctttttgtaaagagtcattgagcttaagtctagatcaaattttaaagttataaagcatatgatgttgtatggattttttaagtgcagaaaattcttaagcaccattttaatcaggcttcccagcttttttccttctttggtggtattgctaatgagaacacagttcttaatttgaggttatattgtcttatccaatgtctattgaaggaaaaaatgttattttaggatttccaagctatgttgtttgcctttctctttttgtaggtcttatacttgctaactcaaagatttactatgagaaaaagtgtgtaatgtgatctctgaaagaaacactaagtgtttaaaatgcaccagaaatctcaaaatcccttttttaatgtagtattagacagcttcattgaagtgaaaaataactggcctttagaagcagtgttttaaaaattatggtttccagtattttccacgattgcacactgtggcatcatggaaattccatgatttcttgagattctaagtgaatgaaaagaagccggtttagtggctaagcttactttatgtgtaatctattaaatcgtgtctaacttcctggtccatccacctgctgtattccattctatatctatattagactggaaacattaacaaatggtgaaagcataaaatatgtaaagtgcatgaagcactcaggactgtcaaaattatttctttcatatatatgtcaccatgctggcttttaggaaaaatatagctaaatataagtgtaattgtttcttccttatgtttcattgagttctatcataaaacaaacaatcaactttgaaatgtacttaaagttctacttctttttctttcttttatagcctttggttcatgtatacctgattgagagaggtgtaatttttcagaacgtataagtttaagtattaaaatactaaaaggtatgtttatgatttagaaaaagaacaatccataagcgtatttttcccctttacttgttgatgagtttttgtctcattgagtcgtcagaaaacattgtgtttattggaatttcatacattacacttcggtgtgggccggaaggaaagctaccacatatggtccttcattcctgggattacgatcagtcaaccatggttataaatggctttggttgtagagaatcttagtgagaaggtaaacatgtatgcataatgtctaaaattagaggaagcaaaataatgaccaaggcattttggttttatcaataatattgcagtctttagtttaaacaaaaatattttctgctattatgattaagtaagctaaagaaagttatagcttttgctaaaaacatacataaggatattggcaagagcacaggaaataaacaaaatccatctagatttatcaaaattatgtgagaatgatgtttgacaaggatgtctggattaaactgaagcctaatctccaacatttaaagcatgtagctagttattttttatttttattaacatttacattgttgaaaaaatgtttattaatgtggagtgaggataggatcccttgttaagggatgggtaagatagaaaggtaggagacattcaaaaagtatggttttctcaaacccagaagagttgggaaaacaagtactggaattctcctccaattacacttcaaacctgctaaaaattcaacaggtgaatagttgcctcagatctgcttacccagagcaaacgccacttaatccaatatgatgataataataattacataattgctatgtgccaggcactgctttatccactttaaatagtgactcattttgtctttaaaactgctcagtgagggagtactattactatcttcactctacagatgaagaacagaggttcagaaaacttcactggcctgttcaaatcacacagccagttgactacaaaatcaacagatgaagcccaggcagtgtagctccagaattatggctcctaatctctgttgtgtagtctgagattctcatgtaatctacaccatagctcaggatcagaatgtagaaactggatccctgcagaaggaaaaaatgatgaaattcataaataaaggatcttgaaagaatgtcttatgttattgtggtgtgatatattttgaacacacttcactataagcttgtgaaagaggaaggtaagacatggctaatccactttgtaagtgaggaacagatacagtgtgcagtgaaaggtagagtgatttttcccaaaaggtcatacaggtagtacttatgcaatgtggagcagattaattatgttttaacattaattttttaaatattgaatagatctataattatcttttttattatatcagtttggatcacatttctttggagaataggcagctatcacccatgactatggttatagtaattttaaagcagtatattcttataaaacacaattaaccaaaaatcaagtgctcatcattgaatcgccttctcttctcttctcttttctcttctcttctctctcttctcttctcttctcctcttctcttctcttctctccccttccctcccctcccgtcccctcccctcccctctccttctctcccctcctctcctgtcctctcctcttctcttcatcgaatcacctttctcttttaggtactgcaaagtctgtgaattcagatagccttttgtcaaatgtcgttgtcagataatgatagtaatctagatgagtttttataatctttggcaccatcttcataaagtacataaatcaggagaacgtataagcaccacgtgagcaatctctttccaaactcatgctctttgctgggcctgtaatggtagcatctatgctaaaaactagcattaaaacattttgtagaagcctaagacctaaatgtttcaaatatttaaaatatattacttaaaatcattcacagtcaagtatcttgaggcttttatgttttttgattagtctcttaattatcaaagagttttcttgatttgcatactttatggagatgttgatggaaaactactctaaacacaattttaaaatattcagatttgtataatattaaagctcgaagagcctagaaagcttcagaaatgaccttttatttggtaggccaaaatatgtctgagatcagaaaaactcaaggaatcatacatgaaagattccacagctgctttcagaacattacctttatatgtagactgcttgctgctttatttattttccaggatatatcaataggtagttgtaaatgtttgaacattacaatgtcatgaacccagtagaataatgcaggttcagatatggcatgacttgctcagagtggcttagccaataggtaccaaactgcactcaaatccagtgttgtggacttcacttcataacaatatgctacttcaatttatatattaaaccaaaagtgtccaagtttccctttaaaactagaatttactggctgggtgcagtggctcacatctgtaatcccagcactttgggaggctgaagtgggtggatcacctgaggtcaggagtttgagaccagcctggccaacatagcgaaaccacatctctactaaaaatacaaaaattaggtgggcgtggtggcatgcacctgtaatcccagctactcaggaggctgaggcaggagaatcacttgaatctgggaggcggaggatgcagtgagctgagattgtgccactgcactccggcctgggtgacagagtgagactctgtctcaaaaataaataaataaataaataaacaaacaaacaaacaaatagaatttacttttattttgtggtggcttgagcaaaagtcatttccaatgtgaggcttaaatattgaaggtgttctctggaacacagtaattatgagaaggagttcagaaatgaaacttacaaaaatatattttgaggaaaaacaaaataaaagagtcttgattcctaatcattttgtaatttatcccttatcattactcttgatttcttaattccttattgaaagtggtatatggcttatttttaaactagtatactgattttaaaatacacttttttgaaaaatcacttaaatattttagaaaatttcttatgccaagtggggtactccaaaagtaaaaaatctatatttctgaaaactgttagctttcattagtatttggcagtctaagagggtgtcttttgtaagtgtacatcactcggcataatggattcttgataaggtagacccaaattaagtttgggtaaatcagaaaaaagaaattctcacaaatacccacattgagttatagaaaatgaaatatttacaaactgaataaatatcacttatgtgtttgttttacttgtagtctttttgagtattttaagttttctttaaaataagttaagcaattatttaaaaagatgtatataaacctttagttccacttgcctatttgactaagaaaaaattcaatatcatactttttttgaggtaccatatgctaaaattcaatctgaatataaaattttttaaagaaagaatcaacctgtttctgagtgacttctgggtaaacaatgaaattaaggcagaaatcaataaattctttgaaactaacatgagaaaaagatacaacatatcaaaatatctgggacagccaaagcagtgttgagtggggagtttataccagtaaacatccacatcaaaaagttagaaagatttcatattaacctaacatcacaattagaggaactagataaccaagagtaaaccagccccaggtctaacagaagacaagaaaataatcaaaactagagctgaagtgaaggaagttgaggcatgaaaaccatacaaaagatcagtgaattcatgagctggctatttggaagaattaataagataggtagaccactagctaggctaataaagaaaaaaagagaaagtttaaataaacacaatcagaaatgacaaagggggcattaccaccgaccccacagaaatacagaaaaccctcagagactgttataagcaccgatatgcgcataagctagaaaacatagaagaaattgataaattcctggaaacatataacttctcaatattgaaccaggaagagattgaatctctgaacagaccaataacaagttctgaaatggaataaaaattaaaaagcctaccaaccagaaaaaaaccaggatcagacagatgcatagctgaattccaccttccttgtataaggaagaactggtatcattcctattgaaactattccaaagaattttctaaaacttgattataaacatttagaaattaagacttcatagattatctaatctctacctttattttgtagatggggaaactgaggttcagatatggcatgacttgctcagagtcacttagccaataggttccaaactgcactgaaatccagtgttgtggacttcactccataacaatatgctacttcaatttatatattaaaccaaaagggtccaatctttcagcttccatgggccacattgggagaagaattgtcttgggccacacataaaatacaccaacactaacaatagctgatgtgcaaaaaaaaaaaaaaaaaaaaaatctgaaaatctcataatgttttaagaaagtttttgaatttgtgttgggccatgttcaaagttgtcctgggccacatgcagtctgtgggccgtgggttggattggacaagcttgtattatactgtcttagggttttcacaaagattcagagaaattcacaactcctgccctataatttttattaccaactatacagtggggtaaaaactataaattgaactgtcattcatgcccacatgaattagtgaagactttctgcaacttaattaaaacacttccactttctcagcatcattatatctagaatcatgagtaacatagcaattcagcattcctgacattgaatattaagtgtaatgattaaagagaacaaaccatgagctttctcatattgtgttgaaatttttcttttcaattggtccttgtatataaacacagatacaccaaaagggaaaaatagtcaaatactattgaataaataaaacaaattccatgaaaatatcaaattgagatgttgaattagaatgaaacaagaattcgaggtcagcagcaacagtttgtccaactttttctgtcctgaaagcgccttgtatagtgatcttggcttgctgaatatcattgtgatacaattcaagtgaagttggcacatgccaactcaggtggaatcctaaggtccctctcatgtcttgagatgcaccattggctaattcttcatgctcaggaaaatacagcaaaagcacacacagaaagatgagtcctgtgtcttggtaggataaagtcagagaagaggtagagaaaattctgggggatgtccctagagaatatgatcatacattaagtaatctttacattgatttaatctttacactgatggctagctctgttctacgaaaagacacttgcattcatttgtctgtcaaagtactattcacatagaatcaaccaaggcacacatcagtggtggattggataaagaaagtgcggttcatgtactccatggactactatgcagtcatcaaaaggaacaaaatcatgtcctttgcagcagtatggatgcagctggaggccattaccctaagtgaattaacgcaggaacaggaaaccaaatactgcatgttctcatttataagtgggagctaaaactgtgtactcatggaaataaagatggcaatgatagatactggggactacaagaggtggtagggaggaagtggggagggcatgggctgaaatgctaactgagtactatgctcactacctgagtgatgggatcagttggaccccaaacctcagcgttatgcaatatatgcatgtaatacacttgtacttgtaccccctgaacctacaatgaacgtagtttcaatctcacagtgaactatgtttgaaaatgttcaagaaaatatcaaagtgtccttccattgaaaggaataactagcacacacacaaaaataaaattgcaagcttgttagcctcaaataaattaactggcagatttcattttgtctgttcttcattgtttgaatatacagtaatcccccttatctttgggggatatgttccaagtcccccagtggatacatgaaaccacagatagtactcaaccctgtgtatactatgtttttcctgtgggataacagacatggctactatgtggaaaacggataagtggtctgtgcagattaagtatgctggacaaaaggatgattcatgtctccagttggcacaaagctagatggcacaaaatttcatcatgttactcagaacaacacacaatttaaaacttatgaattgtttatttctggaatttttcatttaatatttttgggtcacagttggccacgagtaactaaaaccacagaaagcaaaactgtggataagcaggaactacagtactagaagtcttaagaaaaggaaaccagccaggcacaggggctcacgcctgtaatcccagaactttgggaggccgacgtgggcggatcacgaggtcaggagatcgagaccatctggctaacatggtgaaaccccatctctactaaaaatacaaaaattagccaggcgtggtggcgggcgcctgtagtcccagctacttgggaggctgaggcaggagaatggcgtgaacctgtgaggcagagcttgtagtgagccgagatggcgccactgcactccagcttgggcgacagagcgagactccgtcttaaaaaaaaaaaaaaataaaaataaggaaatctttcttgatctctgagagggcccttttcctgatatgtatctgaagtcggcattcagtcattgaatcataggtttgccttggccttttccccaacacagtttgtactttcacctggagcagcaagatgtagatacaggacccagctgttgctgtgaactgattatacaagtttccacttatctcagccttagtatgaatatttcgcactctgcgatgtgattttggagttattgcaatcttaaccaaattttaaaaatcatggcttagatcaggtgataaataatcctaatgcacccagccttcgttagaacgattcctggagttttgcacatagttctaggcactactttataagaatgtaattgaaaagtgctcatgacctttctcgttgtaccattcatctcattttaaattatcatgcttaaagtgtttgcctttcttagcagactttaatctccatgaatgaaagtgctgggtttttcattcatctgcatatctccagtgcctggcatgtagtaggtgcttaagtaatatttattgaatgaataaagatggaaactaaaataatgaaagttagggaaactgtgtacacaggaagtggctgaatcggggatgtttctggagaaaggactgccttaggtgggggatataaacgtcatcttcaaatatttgaaaggaccatgaatggaagagggattttttaattttatgttattccagggagaaatataaagatctgttactgggttaaactactggtaagtgttttggttcaggagaacttaaaaataaattagagtgttcacacatgagcaaagcccttgcaaagtatcaagctctctgtcaccagtagtgttcacagagagatgagataaacattgcagtgatgggtgatagagcaaattctttcatctgttggagggtaagcatgctgcctttgaagtcctctccaactatgactgtgtaactttgatataattgagcacttgatgatttccacttgctgcttgtaaatgttattttttgtcttttaaagatgcttcctaatttcatttgaaaatccatttccttattgttctagctgtgagttctttttcctaggcagacaatgattggttaaaaaaatattgaatgaagtgtgatttaagtacagtttaccattgatttaaatttacacaaataattcctattatatttttagtgcattaaattaggcataggtggataataaaaaataacttggatttgccatatattataaattgctttttcttaccacagacattagcatctgcttgtacttaatttttattcagggggaacttatttaagtctttttcaggtggataaaacagacatgtggccaagattacttaagccactacactgtaattatctcactattgattacttactgattttctgtctcttttattttgattctatgcataggtaggccctcgacgggactggttagtgtataatccagctttgtctggtcttcgaatgctatagttttacatgaaacaaaaataacagcatcataatagacagctcaaagcatattatcacctttctaagtatctgcatgtctaactctgtcaagattaatctctctctgttccccagctgcttctgaaacaggcctggtcttaaatctcaaccctatgacttcattgcttactcctagagccatctctacaaaaatttatttgccaaacctaaggagtaaggaaagctataaaaagaaagttatataagatggaccatgtgtaaataatcacgctaagtatataatgtttacaagaaagtggtaaggcattttaagaataaaatcacatcaaaacctatttgtccatgggaaccagactgcagagtaatgtgtgtttgggtttggaggtgatagatccaaccctatgacaacagtgaataaaggttgttggtaatttagtaccagaccttgagtcatctgtcactgtgaaggcctggaagaatgcatgtcctacaagtcatcttggttagaaaaagcagctgaggcagacacttttctaaaagtttgcctttgtagaacaaaattcatttgtcaaatgaaaggtctttctcatgttcttaaaacattgtccacccactcaataaataaggactggaaaaccttcaccaaaattcaagaaacatttaatgaatgtctgtgatgtatgagataacttcccaatatctaaagtttatcatcagaattcattgcacctctgcagaaggtattgagagaaggaaagggcatatgtggctgattggtccaaggtgccccttctgggctgtagggacgagtctattttggaacaggtcaatacaagtaaaatcgaaattctttagaattctttatctttcctgtgagattttcagactctctgtagcagtaaacattcaaacatcatgactgataggatgaaagattagattttatgcccttgtgacaggagaaaaaggtagagtttatgtgtgtgttgtcagagaaaaaaaaaaaaaagcctagcaagtttgggctattagaccctagactggcaggcctctgtcctcagcagtgcttgatcatgaggcatcttgatctgatctaggccagacttccagtttagatcagggcctctgctaatatttggagttgaaattcagcctggcttggcaactttgattgactgtggcctcggagatcgaggacattcccagaagtctaggtcagctgagcaacagggagtgttcatgataattaaaggctgtcagccttgtcagggctgctgaaatttcagcagaggctttagataaggatgattattgtttactaggccaagtgaacaatgatcactactcccctacagacatttatcacatactcagtacatgtctatggagtgcctgctactttctaggctctattctaagcactgtggatgcagcaatgaacatgcttgcttttatgcagtttacattttggtagaagaagccaaacaatgaaaaaatatgtaatgtcaagggatgataaatgcaatgatggaaaacaaagcagagtacagagtgacttggtaagggaaatgttactttagtaaggtcaagaaaagtttctatgataaattgatataagatcagaaatctaatgggaaaatggagtatgcaatacatagatcggagaagaaagcattccagcaatatgcaaagataaagtgtgctcagagcaagcaggccaggatactgaaggggagtaaagagtaaacagagagaatacagtaagaaatgagtccagagagggaggtgaagaaaatatcatgtgggacttttaggtcatgctaagaacttagtgtttcctttgacagagatgagaagtcattgaaggattgtgaacaagggaagtaacatgacatgactttatatgctattgtgagaatagactgtaatgtggtacaattcaaaacagaccagttaggaggctcttataatagaatggttaagagaatgtggtgggacgccagtgaaacggtggagtaagggcctctaaaaattctctcctccatcaaagcaataagaaaactggcagccaggtgtggtggctcatgcctacaatcccagcactttgggaggccgaggcagtggatcatctgaggtcaggagttcgagaccagcctggctaacatggcgaaaccccgtctctactaaaaatacaaaaattagccgggtgtggtggcaggtgcctgtaatcccagctacttgggaggctgaggcaggagaatcacttgaacccaggaggctgggttgccgtgagctgagatcacaccattgcactccagcctgggtgacaagagtaaaattccatctcaaaaaaaaaaaaaaaagaaagaaaactggcaaaatggtcagaataaacttgtttggaagtctagaaattaagtaaagtcttatagaagtcaaggtgcacttattcaagaaaaacagctgaatgttggtaagaacaatgagctttgtaatatttaattcacttgagtcccattccctgctctccagatctacaacagtattgataaagaagagctcacattctcactgcagcctggcaagcatcagagagggaagaatggagctagagcttactcaaatcctcactcccacagaactgtcagtatttgacctgtcttttttactcgatagacctcacttgcacaactctctgtacttgacattactcagagctaccaagtgagaaaagcctttgctcagaggattgtgtgttaaaacaattggagggaagtattttaattttgtgtctgcctagatggatggataacaattgtggcaatcagtagaataaccagaaaactttaaaggaaaatcttgggaatgaattgtccgtaggagcttaaaagctttgagatatttctgagaacctagaaggacatacacaggtataaggctgagtacctgtccagggctgtgcctgctcagggaaaacctgagaggccctaaacactcacctttggtcaatcttgaggctctgcagaaacaggaagtgaagtctaatgcagagttgcagatgccttgatgattgttgaaagtatgtctcaacacacacatagagtccctcagcaaagacagaagattggttaggaatgaatagatgaccactgagttactctactaagttaacaaagcagagacttcagtggctgcatacagcaaagaatgtgtactttacaggattattccagaatagtcatcaaacaaacacaactacagcaagaaataactgcaaaccctgggtaagaccgtaagtgcattcccagagttgccacattaccatgttcaaaatatccagttcttaaataccacgacattcaaaggcacaaaaaaacagtggcccattcaaaggggaaaaagcaatcaatagcaactatttctagagaatcctagatgttgaacttactagacaatgactttaaatcaggtatttaaaatatgctcaaataactaaagaaaatattgtctgaagaactaaagtgtaagaatgatatcttgccaaatagagaatatcaagagatggaaattattataaaaatagaaattctgaagttgaaaagtataataacctaaaagaaaaattcacaagatcagagttgagccaatagaagaaagaatcaccagccaacttgaaaatgggtcaattgaggttattcagtgagagtaacagaaataaaaaagtacgaagaaaactgagcagagcctcagatgcctgtgggaaattgtcaagcagaccttgctgctcatactcataagtgtgatcttccaaaagagaatagagagacaaagaagcaagaagaataactgaggaaataatggcagaacactttctaaatttgcttaaaaacattaatcttcacatccaagaagttcagtgaactccaagtaggatgaattcaaagaaaattataatggacacattataattaaactatcaaaaggcaaagaccaagagagaattttgaaaggagcaaaataaagatggcttctcatggacaaagagcgtgggcaggtggttcattatgaaagaagagagacagagtccatgggcacaggcgcagatgggatggcagttttggtggtgggaacatgtggaaatcctttctcttctaatgcttccattttttcaaagaagttaggcataagaccaccaactcagaattggagggagagcaggagaggaagaatggaggcataaagatcactagcaatttttttgcaaggtcaagcagtactgaagtcaaaccaatgatataattcacaatgcaccgattgttcattgctattagcaatgcatggaatgtggggagcttcatccttgaactaattatttgttgactgacactgaactttttacattaatttaaatgcttaaatcttaaaatgtcagtactctgggcaaagtccctgctgtccaccctacttggcaggaagattaaacctctgctaaattatacttttacgttctctgaataacccctgcatacctttccctgggctgcattttttgcctgtatgttgcctgaggtcacaatctgggaaccatgaggcaacttggactaggagacatatatatatttacctgtacaacatctttacaaaagaaaaaggatcattggcaatattcaataatgaagagacttttagatgaaaatctgtgtttctggttcctggggtctgaggaaaatctgacacagtgaaccaggctgagagcaactggctggagctaggcagcaaccggcctcttttcagggatctgcacttcacatatgggctttgcaaaccttggtgcagtccattttcacttcatagaatgagtgaacttctcttctgttactgaatgcccaaaacattccagtcattcccataaagactgctttctcccagctatttgtgttcccaaagttcctaccacattttgtaggttcaaatgttatagcacttctcatcttctatctttatgaacttatttgttctacctttttgtctctccttttagatttttaagctgtttagagggagggttggcattttaatccatttttacaatttcactcacagctaataaatgtttctgtataaacaggatcaacaaaatgtgcaatgaataataagtttggtccattataatttggtttaagagactatagtaaattttgaatctatcttaggcacagtggaatgcttattagcaattaatattgatgttacctcagaaaatgttgaaaatctattcaattcaccttggaatgcacaggtacttagcagacaaacaaaatccctagtatgttctacactatcatattataacagtgctttttaagtcttgtcgtggaagctagcaggcatattctaaaatgttgaatgcaaatttgttatcaaaactcatgcccttggactgtattctgtggcatctaaatctatatacagcatggaaagctataccaactattggtggtttgtttattctccttgccactaaagctgaatctttgtccctaaatgctgtcattttatatgcaatttttcttttgctttgtgtgtatttgttgtatatatcgtagtcttctctcatccatgggaaatatgttctaaaatccccagtggctacctgaaactgtatataacaccagactctctctatattatgtctatagtatatctgtgataaagtttaatttataaattaggtagagtaaaagattaacaataaataaagtagaacaattttaacaatatcctgtaattagttatataaatattgtctctatgaaaatactgtaataaagactgtagctgaccacaggtaactgaaactgtgaaaggtgaaactacagaaagaaaaactgcagatgagggggaatactgtaccacagatacacacaaaactggggatattcctaggacataaagaggacttccatgggaaacctagtgaaatccacataagtgatttagtgaatcacaatgcaccactgttgccttctttagttcgacaaatgtaccttgatattgttaagatgttaacaatggaggaaactgggtgaggagtatgtgggaattctccatactgtctgtgcaacctccctgtagctctacaaatattacaaaataaggtttctctaaaaatcaataaatagaagttggtgcaatgtttggaaagtattctcaaattaaaactcagaaagctggtgccatctgacaactctcctgagtttgggaggtcctgttgctgataacagcgtatttcatcaaataattatcaatgtctaatcttcctacatacaagtatacttaaatgtatatatttggattcacacagaagcaagttagaaaagaagtcactgatatttaattcataaagtaacatttaaaaaatcagttactatgtgggccgtctttttgttcagtgacattttattgcctgatagaagcgtagtgctaaagagtatctatcttaagtgccagttagaatgttctatttgaagatagtaacagatatatcctaatgatattttaaatcttctaatgtaagaaaagtctcccgtgatgggtcaggaagatcctcaagtataacggtttttgaaaagcaaaatagttgtttattgtcaactgaactttccagttttttagtcctgactctgaaaagtgttaaaagtagaatctttcttgatactattgacatttcacaggcctaaatgtatcattcaattatttgcactttgtaagaaagatatacctgtgaattatgcatcctagagatatttcataatgaaacttacaatttatttgcaaaaataactgggagtattatttataggtgaagatagaattggcatttcaatgtactgagcttagcatgtagaaggagttttcttatgctatatcctaagtgacattttgcctatttggaaaacattttaaagacagattaaatatcgcatttccaactctcaaatggaaaggtatcactttacagctttattattttcaaatattcaagctcaaacagttttatagattaaagagattgcttaactcaataaaatccagaattctaagtttacatctttcttaaattatcattattgtatacgttgcaagtaacataacatcatcagatttataccataattgtaagatgcaaatgtataattactagaatttaacctccccaaaatgatgtaattcaacctgactatcctggctacataaatgcaagctaatcggcaatgaaacatttaaataaaacaagaacgttaacacaacaacaactgcagaataaacaaacttttcaagaaggaaaaaaacaagggcctaattatatctgcaacaaaaaatcataaatgcctactattttaaagtattttcccgtccattcagactttagctgtggccaggactgtttcaatatgtgttttgacctctacgtacattgatagtcattttcctatattaatttcttcattcagtaaaccatccaatgtctccttcattcagtaaacatttattcttggacagctgtgagttgaacaatgtgaaggtgttgaagatgaaggagaagcagcagttcctgctcttggtctaattacttgtttaaataaaactaattcaaatataagagatactttcattttagggcacggtagctcacgcctataatcctagcactttgagaggctgaggcaggtggatcacttgaggtcaggagttcgagaccagcctggccaacatggtgaaaccccatttctactaaaaatacaaaaattagccaggtgtggtggcacacacctgtaatcccagctacttgggaggctaaggcaggagaatctcttgaacctaggaggcagaggtttagtgagccaagatcgcgcaccactgcactccagcctggggcaacagagcgagagtccatctaaaaagaaaaaagaaagaaaaaaaagttttgagagacacgatagcaaggtaatttccagggtttctagattgggtgaatctcagagcacagtgaaaacaggagctttaaacaaattggaagagaaccttaacgaaagttcaagttaataatgtattattattattattgaaggtttttggacagaggaaatttgaaaaagcaagtcaattgttttcctcaagtaatagtttaatatagatatgaaaattattttatatgacctattactaatgcagtagtatctacctttctttccaatgaccaatttttctccaaaatatgtgatttacgtttccttaatttcattaaagatcagtgttttcgtctctaagatagtaatatgtagatacttagtactcagatgtcaaacaactgaactgagaaaggtccaaaataaatgtctgtgcaaatgagccatatgcatctgggttaaaggacaatgacaaagtcttaaccagtcctgcggtttccagctcataccctgacacaagaaagggcaaggagagttgtgtttaatagtatattcttcaattaaatgtcacttttcttcaatgtgtactctgggtgagcacactaaaatcatgttttgctgcaatgtcatcacaccaagttgctgactttcttgttgccatagcacatggtacaaagatgaattctgccataggataaacttaggtcttaaaagcctcatatcatggagtataatgcatattcttcttttgcaatccatagttctaacatctctatttctcccttttatgttattagcaatcactcatatcacatgtggatgagagttaaataaattgaaaaggcattactactgctcttaaaaaaaaagagagagatactctcattttaaaaggttaatcagatcacacatttgcttgcttaaatttctcaaatatctttccattgggcttaaattcgaatccatggcctaacaatgggctacagtgctctataggacctgcctccgacctctcacctcacttcttttcctgctctccagctctaccctacagcaagcacaggagcttcatttttatttctcagaggtacttgactaattcctgcctcaggacctttgcacttgctcttgctgcttctgcctagaatgttgcttcttgcctcctcattcccaagtcctaaccaagtcagagattctggttagtgctttcctcatactatttcattgcatttattaaaaactgcatcaccacaaagagattacatacttctttagaaaagaaaagttggagaaatcctaagaattttgtggcaatgaaatcacaatcatgatcagaaaccttatgaaaacaaaggtacaacacctgtaaagtcctatagctaatttaaattatcagaaatctcataaattagtgctcctttttgatcagtgtaaaaatacttgacaaaaaatataattggctctgtcataaatgtatctgaagtcaatatgtaagctataacaaagcatcacacttttcattaactaattttttactgtttagaatttacaaggctttggaggaagataatttggaacttccaggtctcctttaaaatcatataaaataggttgtgtttatgtccttttctctcagtgaattatttttacatcaaagagagtaaccatgatgctcaataaataaaataaaaataaataaaatattatttcattgaaaagagtttttattttatttatttatttatttttgagacaaggtttcactttgtcacccagactggagtgcagtggcacgagctcgtctcactgcagccttgaccttctgatctcaagcaatcatcctcccacctcagcctctcaagcagctggggactgcaattgcacaccaccatgcctggctaatttttttgcattttttgttagagagggggtttcaccatgttgcccaggctggtcttcaattcctgagctccagtgatccacccgcctcagagtttttatttttaattgagtttaaccagcacatttttccttcatttttttcttacataagttcagccacaagtaattattatttgaccagaatcctgattctaagaagtagtcatgagacttaagaaatatcattttatttacttgtttatttaacacctgatattttgtctaaatgtatctaatgcaacaataatgttaatcgaatataaatataaacagaaattaggatcatgaaaatagaagggaaaatacactaaccaggaaaggtgaaattttaggcagaaagtgattcagcctcagtagatctcagttttatcatttaatctagatcaaggaagataagtatgtcctcccttgtgtgccaaaccagttttgttggaagaggagtttgcactgtgttaagaagtgtcttgaggccaggtaagagctcaccagggagcaatgaagagatgtttccttgaggtccaccaagcccacagaatttggaaatggcagcacatttgctgtgcattggcaatgcctggacaagattacagttgccagtcattttctaaagtttcttcattgttgttctacaatttctcactgttcagtgaaagccatttgctaaaagtgaaaaatattccaaatttagtatttatttattcaaattttcttgtaatttaattttaataaatgcattatgagtgtatggccaccacttttctttcctaatgttcttataatttgagttctgcttaatgtcatgtttatgtttctgggtaagatttctggaagtaactggcatcatcagaatgaatttgtcatcccccgtcttaattccgatctctttgcaagtttctcaaaattggatcaactaattctgagtaatgcaaccctaatcccagcacctagtagacatctactaggttggatatctgcattcttcccaataatcaaatttattcttgtctaacccaacgttctgttacttttcaatccctgaatgcctaggacttctccaccctcctctggcctgtcacctgtgttggcctggactgtaagtctttattatttcctgaaatatgctactgattccttctgagacttcacacctccgagcctagaaccccattctaaaatagtatcaatggattagagtttagtgtcatgccttctgatttcttatcaactccaattccctaggaatagattctaatcttgaataataatggcaatactagaaaacatgttttgaacacagactctaggctattaggcaatacctgggattatctcatccttaaaaaacaatgtatgaaacagttattcatcttatgtgtgagagcataggaaagttaagtagcttgcccaaagtcacaaagcaagtcaatgatacagttgaatatgaaccaagttatctgaatatgaacgtgagctctctactctactgccccactggttttactaacattctgctcttgctggacaggttgcaggcagagtgcggacacagagaagacctgccttgtcaagactggcgcccaataagacctctagattgggcccttcccctttcatctccccttactatttttatgactttatttttaaatgtgtacaaagagctttgcttggtactgaggatatgtaactcacaaggcaggcatggtcccttccatccaccttagaggcttttagaggaaagaaaccttcatcacctaattttacaaagaattgcacatccagagtagtgataagctctactaagaaagattgcagtgtacagtaaaagcctacaacaggatgacctaacctattctggcaggtcagggaattgctgcatctctcatcaactccattgtatggctcaatacttactgtgtggttcacacatcacttctcttccaggttaaactacaacaaagtgtcttcagcagaattctagctttgagttgcacagatcctggtatgctttgcagctctcccaattccccgcagcctcttctttactaatagaggttttactaaatatatttattaacatatttcaagctaccattaccttatcagacctctactctgctgaaatactgagcaatattgttttattgattgggtacctactgatggtagcaatatgcaagtgtgcattattctcatatgactacagctttaatagtctggaggtaatattgaaagtaatttactgtcgtctatagatggcagttctagtgctgtggtacttagggctgccaatttggaaattccagtatgcatacaaatgagttattggaagtctttttagaactaacttgataaaacaaaagggcaagaaagcccaccactgacctgatagccatccacaaatatagtaattgggaacaatttctttggaatgaatgacagataccttttccattatcttaagttttctagtagaatcaatgacaggggctgaaagagtttgtggacatgttgacttaatttaatgtctaaatcctgaatctttttgctaactgcagatgcaggatttagacactaaattaagtcaacattttcacaaactcatggattgcagaattctcctgcattgcagtgttcatcacatgagctgaaggcagagcagagatttagacaatgaaaatactgaaacattgtttttcccccaccagtgataacgttaagatgtttcgtatatcaaattattcaatattttatattatcaagggaacaatattaaatagaagcaagcagaaagcctactctctcacatacaaaaaatattattttatattctttgcttcctttggcctaaatgcagttaaaaaaaaaacaacttaggttctataaatatgtgtagatcttattgatccattttaactgctagatagcattgatagcatcccactgaatgaataaatcacatttatgtaaacattgtacaacagagggacaattaggatgttttccttttttaaaaaaactaaaacacacagacattcagtgaaaaattctgtacatatttcctgtgcttatctagtttctcttggatagacacccataaaaagtgggggaaaaccaacttgtgaaaaaaatgtgcagtaggattgcaattatctaaatctttaaaactcacaaacattgtttatggatgaatttattcatagtgtagaagttcataaacatgcatgaaaatgatccacaccattttcaagagagtggatagtcctggggagggcgggttaaaggatgagagtagcactttagcaatatctgtaacaatttacttctctaaaaaaaaaaaatgatctggagcaaattgcaatatgttaacatctgtttgatcctggtgatgataattacatagatgctgtatttttcctatactcttaaatatgcttgaaatgttttgtaagttctgtgaaaacgatgttttacgaaaagttgtcaatgttatttaaaaaaagaaaaatcttgtgtgtaccataagaacattagaattactgatacaatgccttatatgcaaacactcagctgtctcctgttggaggaagtatatatgagttagaaaaccagctgtgaaaagatatcaaatttcagctagtaatagggttcacataactatgaaactaaatggcactttctacttcagctcactgggggctgggcgcggtgactcacgtctataatcccagaacttggggaggccaaggagggaggatcaaagtttgagatcagcctgggcaacataggaagacctcacctccacaaaaattaaagaaaaagatagctgggtgtgctggagcgtgcctgtagtcccaggtactcagaaggctgagagaacaattgcttgagcccaagaggtcaagactatggtgagctatgatcgtgccagttagtgcactccagcttgctccagcctgggtgtcagagcaaggcaagaccctatctcaaaccaacaaacaaacaaacagcctgcgcccagcctgggtgtcagagcaaggcaagactctgtttaaaaaaaaaaaaaaaagtcttcagctcactgaactcactggggtgaaagggagctggagaaagtatctaaaaatctcaggagttcagggagctgacccaagtgcaacccaacaaggacaagccagcctcagtcctgggtgagctgaactcggttacagatttgattcaacccttgagtgggaaggaaggaatggggcctttaactccacatgaaataaaaactgaatcaggaataggctacaaggaaaaccagagcagaagatcctagaagcaaggaaggtgaagctgagtggggaagctgtgcaggcagtccatgcagggggagtcagcaagccagggtttgagtgatgggcaagataccaatctttctgagactcagtttatttatctcaaaacaagggtaacactatctggaggatattcttatgagaattaaatgaaataacatatgaaagtacttggcacctcaataaaggttagtatcacctcaacttagtagggtacatgctttcaagggtaggtcagggagaggagacagagaagcagccggcaggctttagctgaagttatctcaagcactgtctcagaagggatccaagaaaaatgccattgatgctgccactccccacatctgtcagtgggatccagggaagaataagtccattcagtgactgaaaagagttgcaaatgaatgaagaaggaacatattagattatgcatgcatctctcaaattggtcaagatgcggcagccacttaactcagttacacatgcttaggaaaagcttagcggtctgaccacaacactaagcaccaagaatgctcattcatgttccagacactgatccgcagtgcaggcaaggtgctcaaaggggagacttgagtttctgctgcatgagctgcaccaacacaaactcttctgtctctgctgtctgctctgcaaggctgtcttgtgctttaaaacattcactgcaatatacatttccagtggtcgattttgaaggcaagtaagagtctttaatataggcattctctatctactgctatgtttgcacattgctgctgtttaattctccttttattcaaattaaataccttgcagtcattcagaaactgtgccttctgttgccacatcttcctgctgtcagagcagctaattagctctttgcaggtcttagcttctgaagaacttgaaaggatgatttgtaattgtgcactgaagtacagcaagttgcttcaaataaacatggttaaaagtctattgcttgagatttgtcaatttttacacgatcatttatcattttcatttatttggcagcaatagaaaaatcttattcgtttcactttcctgaaggtagagccatcatcatttcttatacttgaacaaaggaagactgtaaaaacctgaggaaaaacataaaaaggaaaatggggccttattgaagcaaaaagccctataaaatctgaaaaggacttctctatggaagacctataccataaaattgattcttattgctactgttacctttaaaggggtcaaaaatgggagcttataaagaatctttcttattcatctttgccagcagaatgaaatccattcttcttagattggcattcagaacccttagggattttgaacttgacacatttctctgatcgtttctcctggtacttgtctgcatatacattatgtggcaatttttgaacatctcagtctttccttaatagcctacctcaatttttactttcttcctgagtcctttccctacactactaatggtcactctttcccagggatacagttagcaaataaatatacaaaatgctcagtttcaatttgaatttcagagaggtaagaaataattttaatatgtctattttgtgcaatatttaggatatacttctactaaatatggattatttttatatctgaaattttcctacctgtgtcactgttttgtatcgagcaaccttacttccttctctgaactcttgagagacttgttgtcctcatgacttacttgtcacctggcatttccaacctaatgttgttgtggtcttcagtcagattttaagctccttggaaatgtagtggaatcccactttcaattaggatacagaaaggtgtaaaagatcttcattcatgtgatcaaaccccagaaatcaccaagcagacatagaaacaaaaaatatatacttttccttaaagatgttgaagcacagtgggcacaaagaaatcttatgtgaactaagcaccagagggacaaactcttggaggtgagaccagttcctaagacagggagcacagggaagccagctgctagagaagggcagtctttgttgtgtccaaaagaaacctgcaaacgctggacaaatctgtgtgctggcaggtcacttttgaatctgaaggagcctactaattccctctcatagaattttactgaataagcagagaatgggagctggattggcaaacgtacaaagaccacatggtcttatagccagaaaaaaagaccagttcttagagaggaataataataaatttaagaaacaatgacagcatgaagatagaacaaaaccttttaagtgctaaaacacaaaaactaaacaatatcatcaatctaaaatgttgtatactctaaaaatatgtttcaaaaattaaggttaaataaaaacattttcagataaacaaaagatgagagaaattgttgccaacagatcaaaatcatcaaaaatgctaaaaagagttttgtaagctaaagagatgaagtgccagatggaaatccagatctaataaggaataaagaaccccaataatggcaaatgaaagggtaaatataaaaggttattttttcttctaaatttttaaaaagtcaattaaaatttcttacagtatgtgagagatatatgaaatattaatttaaggtagatcatgataagttaagcatacatattgtaattctcagagcaatgactataaaataattttaaaagtcatagctaaaaagccagtagagagatactaaagcctactcatttatatcccctcctccctcccaaaactacaaactggaaagtaaaaacaaagaaacaaagaacagaagggataaaaaaagaataaagacaatgtgttccactcatagaacctcagctctcctctgtgaaataacacagttttcatgatgttcgtgatgagaataaagtgaaacaaaataagaaaattatttggaaacatacctgacacatgttaagtcttcatgatattaattattactatctctatctttgctataaatgactttaatattatgaatgaatgagaaagccacgacacttccatcccagccctgctcttcgtgggcccttctgtgagacttggctagaaggctgtgcctccatggtcatttctgttccagactttttttcaacagcttcattaaaatatagtttacatgccatatagttcacccaattaaagagtatgattcagtgatttttagtatatctacggagttttacagccatcacataagctaattttagaatgtttcatcatccctaaagaaagcttgtaccaattaggatcccagaatccaccctcaactgactgaacctctgctggtagactacacatatctgtactgtaacaagatcctacaagtgattctggagaatactaaagtttaatagctccaaaggcacatgtttatgatgggctcccaggtgtgatgcagcctaggggcccttggaaactcatgttgatataaaataaaaattcttgctaaggaatatgaacaaacatgttatctaactaatatgaagcacagtggagagtagtggttaagaacaagtactgtggcaggatggggtcagattacagctctcttcttgaacttgggcaagttactcaaactcatgcagcctccacttctgtgaaataacacaattttcatgagattcataataagaataaagtgaaacaaaataaggaaatttgaaaaaatacatggcacatatcaagtcccccagatgtcagtaattactatcatcattctagttaatatagttaatagctagggatttcagatgagggttgtactaggatgaatttggagcattctgctgctcaattctaagacaaagtaagaaggcttaagttttatgaccatggcatatatttcaagggaatgtagtgactaaaaaatagatatataaaagcacagagggaagtgacaagatagcacattgttcatcttattcagatagaatttagaagagttgagccctcacatttttgaaactgttattgtggaagcgttgactattgccatgttttgtttgctgttaaagaattgtagacccgtgcacatgttagacagttagtatctttttgtttctatggtgattttttgtagtttttttttttcatttgtttgttttgttgttttgagaatggagtctcgctctttcaccaggctggagtgtggtggcacaatctgggctcactgtaacctccacctcctaggttcaagcgattctcttgcctcagcctcctgagtagctgggactacaggcacgtgccaccatacccacctaatttttgtatttttaatagagacagggtttcaccatgttggccagggtggtctcgatgtcctgacctcgtgatcctcccgcctctgcctcccaaagtgctgggattacaggcgtgagctaccatacccggcctctatagtaatttaaaagtcattgtgccctgcctcatatacagcttttttgagtaacttactattatttttaacatctgttggcttgtccctgtctcttgctttaatgtaaaattcctgtggcccctttaaattgtcagcagaaagaaataaagtggcttgtgacaccaagacaggggaaatgaaaggcaaggaagaatgctgtgacttcagggtggaaagatatgcggtttgactacaaatgtatagtcagctttgattgagggaaacataggaagatacaggagcaatcagaggaaactcttacagatctcctgggcagaggaaaaagtcagggcaggaaatgttcctgcagagagatggggaggaaacagctggtgaaatgttagcgtatcaatcatgtgtggaaacacacatggagctgagccaggtgggagtgcaggctccttgcaggaatgagggcaaggatgggctcagatttacataattcacacacccgcaaatgtacgcatgcacacacacacaaacgcatgttttttggagccctttgccaaagacagtgacaacagtacatctattttgcactggcagtaaaaaaaaatgtgaaactggtgaattggatgaatgagtactgtaggctttccctgtgtgagccagggctcaggcaatgagggaaagagcaatgcaggctttattttctttgacttcgtggctctccgaaggcatgttctctcctccctgcctcagagtccgggaaactattccctcacaggatggttgcttatggccattccttttatatgtgcatatatggagcttccttgggtgatagaaatagtattgctaggagatgaggatgcttgcttcattttgtggagaaggctgctgtgaggtgtgtatttcaggacccaaaaagtaccacagagaaggaaaatggaatggagtaactcagcagtaaaatagaagttctagtcatgattccgtcaagatgtaatcaacaaggcaagaaccctgtgggcacaggccagaagctggggataagaggattgacattctgggacccagagaagaaaagcaggactgcctaaaacagtgaggggattagaacaatatttaaaaagcatgtaatttccagagccagccttgaacctggcaaacaaactaatatctgtgagctaaaatcaatacatatataacataattatttttatgtgaatagaggtatttattcccagaaaaggcaagctcacttccgtctgttcttaaaagggcactaatcccatcagaagttctccccactcatgacctaataacttcccaaatcctcatctccaaaaaccatcacattggagattagggtttcaacatatgcattttggaggggcacaaacatgtaactgataggagttattattattattattattaccatgttactgatgaggaaactgagacatagttaatcaactggtaactagtagagccgggtatccagctagttagtagttgctccagtatttaaaccaaggtgacacaggtccagaatctatgcatgcttttaaccattagactattatgccactatacaaagccaaggtcacagactccaatggccactgccaaaatgattgtctgttaccttggaagaaagtaaagtcatgcattgtgcagtaactctgtggatggccccataaaatatataattcacagaagaactgaaggtataagttttgaagtccttcacatccagcttcctgtcctgactctaccaacactaagtcatgcaatcatgcacttaccagagtctgcagcatgaagataagtgttactgtttgtggtatcatcattatcattattaataatctttattatcaatataaataaagtaatactttttcctttgtgcttcttaacctgatagtcctttaaaatcatctggaaaggttttaaaaaatatttatttcctgagccatacactaaaccaaataaaccagatgatcagggatggagtcagggttagggggttgctgacccgtatttttctaaaacttcccacacaattctgagttacagacagtaataaaaattgcattggtcaccaaatactcatagaactttcaaggtagtgtgctgggtatgacattttgctggacaccaaggaggttctcgcaaggaggttcttgtaagacacagcaccctgccctgtagagctctcagcataaagctttatggcattcacctggggagtaggcagggcctccactcctttatcttccaatccactgtttctgcttctcactgtgtgtctagtgtcgcctgcaggtgctagcctcatgaggccataaaatgcagggttgcactcgatatgtcactcaggctccttgttcaccaaacctgaggactttgaggattcattcctggacatgagtgtttcagtgggaaatgccttaaatctttatagatcaattgtgttattattatcactattattagaactgtagtttattaagcacctcttatatcctaggttctctgacaggtactctacctacattatctcatttggccccctaagcaacccagcaagaatggagctattatccaaattcggcaggtgaaggaactgacgtgagcaaatcaagttgccccaaatcacatggcttctacatggtgaagcctgaatttgaacccagatctgagttccaaaggccctgttccctccactgggtttgtattgtcatggctaagactgcccagctcttgctagaactgttagcagcttcttgccagatctggattcatcccaggttgtcctcagtcttgaaaataaaagatcagttttggtttctgagggcagaggggtgtcatatagggactaagaaggttccagaaacactggatgtgcccaacaggaacctttcaaaggtcagagaggagaaaaaaggtatctatggcctctgtgatcctgaggatcacggctgttaggagaagagatgaggaatgtcccagccctcagggtcccagagtaaatgtccagaagtaaataaaccttagatatgttattttacaagctccaatagttgcaaggttggtcaggatatttctgctccccgcctttcccagagaaattgtagacaataaggaaacaagtgagaaaggtaaaagaataggaaaaaatgagaaaaatcccagcgtttccccagaacattttggaatttagcttgattttattttgaatcaaagatgtttttaaaggaacactttgtttttatatagcatctcttttctcaaaaatttaaattggaattcagtcactgcatagccactatgctttacattaggaattcagtacttcttcatcttataactgaaggtttgtattctttgaccaatatttccccctttccccatctcccagaccctaataagcattgtgctactttccattactatgaatttgacttcttttagctgccacatacacctgagatcatctgagtagatctcacatgttctcaccacacacaaaaaaatgatagctgtgtgaggctatgttaattagtgcaatgtggtaatcatttaagaatgcatacatatatcagaacatcatattttatatcctaaatatatacaatttttgtctgtcaatcatactttaataaagctggggggaaaatcactccatagcttgccatgttacagtattttcaggataaggtcagggggaaagtaatgaagtaactaacttggctagttaggaaggaagcaatgtttggattaaaaaaaaaaaaaaaaaggaatagagaagaaaaatgatttccaagagtcctaacaggagagaaaaagcccgaccaagacattttcaaaatggccctaggagacggaagcttcagggctaattgaaaaaaaggccctagatttctatttaaatggcagtcctgagttgtacccagaaaatcatttcctgtattactttcagtctttctttaaagctagaaaccaaatccaaggactcatgaagtcaattgaataatgatgagcagtaggtcccacgtgggacctggggatggggcatgcattttctcagtgtcttagggaacagaaagtggagagacaaaattgagaagtgatcagaatggagtcattcttcagggatctgaaaagaggtaggagagggcaccctgaccgggaagtaactggcatcccaaaaaagtataaacagcctcaccttcctgaactgccagtgactataagataagatagccaagtagttatttaaaaactcaacatctcatgcttctcatatttataatcatcatttcattgtcatttcatgtttattgattgcctttgtcacatgtaattctaaatcctccccgatctagatagtcagattcttgagttttaatttcctctaacctggaggaggttagtaagtgttcaaagtatcctttgcatcattcctcatctcatacttaatgctccagcaacagtaataacttgtaattcctggtgtatccctcaccacctctgacctgcacaccccaccctcttcatcctccatttgtctagccatcttgcattcatcctggagggcacttctcaggtggcacttcctccgagaagcctcgagctggattatgtatccctctcatatggacatagatgttcctgtgcataactctatcattggacttaccatgtcatacattaactatctatttatttgtgttatcctgactagacctatgagatgcttgagggctgggcctgggtcttgctcatctttaaatccccaccagctagcacagaggcaggcccatagtaccatttggtaaaagtctgttgatgtgataaccaattaaactaaaaaaggatgaaattgataggaaacctttacaaaaggtcatctagaaatcgataccaataaccaagacttaaaaataatttccccttctctttatgacttggcagaacacaagacaaggggttcactaatcaaagaaatcatcgtatgctttgagatacaattaaatgtcaggtgtgataaagtcctatattggatagaaaattcctaactgtgaacaggttagactccattcaattgaaaatctaatttatttgaacctcagagtgtgtttaccgaatgaatctatgctgtgaatggtggttaggtggccacagtagctcaccagcccacaaaacccaatgcagcccataatgcagctgagcttctctcccctgtgaatacctctctgctgtttctctgcactcaaacatatcatgggccctgaggccttgtcgagattctcccatctccctatcgtcacttctaggaagatactttccattcctacacatagtctgcctttcactgttggttatcgttttctagcctcctcttttattccctctcacacatgtctttgctttctttattttttaattctaaggttaatttttatttcacacaaaaaagcaggcaaaacaatataaaacacgtttaaaggataatactgagtaagctttaagtggagcttgagtctgcaaaagcggtgagtccaaagggagagggaaggccatcttgctcctgggctgcattgaaggaaagaataaaggggacagcaagggactggcaatcccagactggtgccggctaatatcttacttccaccaatttcaatcatgcaaaaggtcaaattgtgctcagggagagctgtggtggggttgccaccctgaggagttgaagagtgagctcagtggcacactgggatggagcctggtgacagatgagcttggaatttcaaagggatagtctggcttagctttgcctgcaatgaccagcaagtcttccaaaatggattcagggaagagtgccagcctttggcctcaggagcctttctggtgagagattcatcacacccagcatgcacagtggccctggttggcaggccctcccttcggggtcaccgcagacctacatttgcaggggccggccgtgctagagttcaatcatgcactgacatcagggtttgcccatttcatcgatattactggggtaatattagcaggaattttactccagagctaggccttgccttttcatggctttttgttgttgtttttggagaagggagtcaggataggagggctgttgttgtttgcttgttttcaaatttttcaaaaggatgttataatctggagtcaggagaatttgaattaactcccacactgagcagtgcagtacgggagaagaaaacccaccagagacaccagagccgtctcttctcctttgcagagccttctcggctaaacacaacttgaagattttgaataaatttgggcaagaaaagaagcactgttgttttgaagcagattgcagcagtgatttttaaaacaaagaaagcagaactggagcatctttcatttttaatcctttaattacagtttacttggaccactgttgattgagaaaactgtagaaagttagtcactaccacaagcaaaaggcaggggatggatgtgtcctttctccacagtcctgctttgcagagtgttggagcacactgcggaggctctgctcacacgtggtggaatgcaccctggcagacttttgtccacaggtcgctttccccatgtttccttgtaaactcttcagcatttcataaagtattattcggctaggtgagccaggagtgtcaggctgagcagatgctcaggctgggtaaccaatgctggactggagtgtgtggtcatccctggttgctggctttctcttctcagtactaatttccaagcagacggacctccacttctagtcgatgttcgggtgatagatctttgttttaaatctggtcttttatgatttgaatgggtaatcttctcataggttgattttgattctgaaggccgccttatcctatggaggttgtcagggacaataagcccttgccgagtcaataaattagcttcttcaacctggatgttgcgggaggctttcattccgcatttgcagcttcttcaagctcctctaccagcctcctgttggctgccccctttccctagctggaacctaggatccagcttcttaatccttcttaaaatggtcccctcctctccatccctgtaagtcaagctcctgcattacaacagtactctcttaattagtctcactgcctcaacactggccccctggatctaccgtctaccttgcagacacaatcagcaaacagacctgttagtagacacgccaagtgaagggctgacagagaaacacatgttgacatgtcttcagcagatacacaagtcggtaggtgctgccctcctgtttcaagctctgtactggcttcctgtgcactcagggtaaagccagcccttcccacagtggcattcatggccctctctgatgggttcctcctgttttcctcactggactcatctcttgtcacctctcatctccctcgggatgctcttagcagactctaggctctttctatgtctgtttcaccccagtatttccctctttccaggatgtctcgcccccaggcatcttcctaccccaacacccaccatgccactcatccactaggtaagtatctactcatttttcacaatcattcagcttgaaggtctgcatcccatgaaggctttcctcattcaccattagttgaactacttctgctttctgctccgtggggtttggggcctgtgcagatcttggttatgaatagcccttttgttgtgatttttaatagagagggagcattgcatcttggttttgagcatctgctcagagctgaattttctgagttcatatctcaaatcttcgtttacaaactttccaatccaggacagattgcactcattatggcactaatatggtgaatggaataaatgtactctaagttatctttctggataagcagaaatctattcctttccttttcattctgcatgggatttcttctctgctcagatgtgaacagagatccaaggtggggaacctgggtcttgggccatcactttctgatgtagcctctgctgcagcacaaagggtcacatagtggtgtcttccatcacagcaagccaggaacagaccttgtttgggcagcaacagcaatggtccagggaggggctcagtccaggtgtaggccagcattcactaggctgtggacttagtggcagcagcacctcccatccagccaacaaatgcattcctgtacataactctgtcattgaatttaccacattatacattaattactatttctgttgattcaacaggaactgcatagtccctgactgtcaggaacaacagagccctgcccctctcaggggccagagagaggcatggtcataactgccccagggttgagtccttttcatgatgtatgctaaattctggtgcctcctgcttgctttctgtcctcacagcatcacaatgaggacaaaagcccaagggagaaagattggtgactgtggcagtgagaatccatgggtcaactgtgaggtaaatgttcttaagatccattctcgagaggctttagaaagctacgtggtctctgtatatgtaatttcaagatagatgtgtttgattatttttatttgttttcaccacaatgagtggaaaagaacatttttatagcactaatatgctaaatcctgttaaaaaaacacccatttatttgttccttcagtagatgttattgtgtgcccgacatgtttgtgtaatcccctgtacttgaaggtcagtaatagagcttaaattatatgtatctggggtcagctttatgcggctttttattttatgccaagaagtttggactttattctataagactgtggagcaaagaacacaactgaatgcaacacaactttgtgtcatgtagatgattctggcagcagtgctgaggacggggtgaagggagaagtgttgggagccaagatcaggtaagaggctgtagttttctttcagggagaagagactaaaatctaaaccggacaatgatcctgggaaaagagaagagggaatggatttgagagcttttctggaggtcaacttgagaggttgaacaacagatcagatatgaaccctgcaggaaagtgttttagcttgagtgagcagaagattgacagtgcataaactgatttttgaaacaggaatggggcggggctgagtgatgacaacaagtacatattaattagaaaatagttgtaggcttcttagttgaatacaggcagtataaatgagagtgtcagtttaggaataagatcagggttagagataaaagaaaatgtgggaaattgctggtgtatagtcaaaactgtgagagagaattaaatcaatcaagaccaccaaaacaaaaagagagaacgctgaggacagagtcctagggacaccaacattttagaggcaaaataaaatgagtcggcaaaggagattgagaaagtctgatgagtggagaatcggttgagacagatagagtggacgttctaagtgaagagagttcaataaggcaggccggtatcagagttgagaaggaagggacccttagtatgttggtgtctgtttagctcaaagaagaacgatcttataagttaatttattttaatttattgcatgcttagctcagactcacaggatttctttctttttcaaaaaaaaaatgtctttgtgtaacttttttcatcagaatgttaggtggtctaaaagttaatgtattagatatttgaaatattttcctttggtaattcaaaatattgcttggatgtaagttttatgtctggtgtagctaaccacaagctgagtggggcatcccttgcacttgtatctgacgtttgacttggtatccttgacctaaggcaatgtgaaaaagtaataccctttattacagttttactaacacacagagaaaacttccgacacacaccctggattggaaaagtgaggaagacattattaatcatcgctgggcagttctcctgccattcttactaccatttgcaattgtcttaaggctcagtaaatggcaactggcaacaacttcattctgcatcctttttctgaggaaagactgcaaagtggaagaatgaaggaagtctgagggggtggcatttaaaatatggttgaagcagtttgggaagtgttcttgctgctgtttagatatctgatggcccaacgaagtggaagcaagcacgcccacaaaaacactcatctcatgcagaccctccctgaatctcataaggactgacagctttgacaccattaccttctctttctttcaatggggccatgcactgaaatgccagattcgtggaccatgctagagcagagagttcactataatcaaaataaaggcctgaacatttaaaatatcacaaaggtgctaatttttctcagggcattgaggactgctggctccccgtttacccaggcactcactggcaatggtcactgatgagcttgagattgtaaagcagattttctgacacactaaattctgtttccaaaatggcatgggttgtgctaagaaactgagaggatttttgctttctttgtaatcagcagaagctcagaattatgaggttcactcactggataaaggactgcacttttcacggatggcagtagttggaaccttaaataaatattacccacggagagaaagagataagggcaatatggacaatgtcattcttgggctgatttctaaaatgaaaattcactcttctttttatttttaaaagttaagacagcattgcatgttataattccagcagtgatcttatcatgaagagacatggttgaatttccacgttgtctcaatagctggtttactgccttaatgttactttcttttaaaattgtatttttttcaagttttgaatatctgcactgtaaaatataatcacaaaattgttgaaaattcaacaatttatggctaggtagaagggaatgagttgaaagctactaatagtagtgtaattcaatcccattatcaccacacatcttgcaaacatatcactttatcctaatatgtgtccattgtcattctttctaacagctgcatttagactagtttcattgccagctacaaattacaagtgcaagtagagtttggggtagtataccaggaaaatgacaaagagtaaatctgctgaggagtctggatgttatcaataaatgtgagaactttgagtgagttttgtagcttattagatttctagaaaggtaactgggccaccaggcagatttactggtccatttcattgttggtagtgttttaccttaaaatctaatttttaatttaatgaattagacattgcatctttaaactgaagttttataaagttggagatcactcttgctgaacagaattcagtgctgcaataaatttggctataacccaatcaagtcttaactcaacctcttcctattccaaagacaccacctccttccctgattttgctggttcacccacagagaacatctcagttttctggaaacatcccaggctctgctttacctcagtgtcaccatacatagtgttctatgtgttttgaaggcattccttctttcctctgctaattctggcctatccatcaaggatctccatgacttcttagcaccactgtgcctctttattattacacttgcctcatcattttatgtaactgttcattgccccatccctaataggcagcaagctctttgacagctaaaatcctttctttttcatcttcatatccctattgcctagctgaatgggtagcccatcctctcaataaatatttattgagaatgaatgaatacatgaggaaatgatgaaggtatattgttagttaatgtgagtcctgttgcccttttcagtccataaaagacttgtggtaaaagttatcagcgtataggtctcttactagcctagaattagtagaatattatcagtaggagataacgacatctgaataggctgctactaatagaaaaataaaccatattttattgtgagcaaaacaaaatttttgcaaagcttgagatgctgaggaataactgtgtgtagggctgtattaatcagaggggtagttagcttccaggactacaaactattggttcaacttttgctctgccacttagcacctgtgtatccttaacctccctggtaattatagcttccacctattcatattttatatattctagcaaaatggcaggcgtgctaagtgttcaatgaatgctagctattattattccatttatcataggacaatcatctatttgtttaatttgaaattttaaaattaatcacacattagtctaagtatatatagatcttggctcactgcaagccctgcctcctgggttcatgccattctcctgcctcagcctcccaagtagctgggactacaggtgcccgccaccacacctggctaatttttttttttttttgtatttttagtagagatggggtttcaccatgttagccaggatggtctcgatctcctgacctcgtgatctgcccgcctcggcctcccaaagtgctgggattagaggcgtgagccaccacgcccagctgtctaagtcttaaagtgcaatcatagccattaaatgaaaatatatattctcaatttttaaaaattgtctatagccttacattatagacatgtgctaacctcagttatctgttatatcttatataggaacatgtctcagaatgaacggaaactctaagggtctctgaaggtctttgcagtcttaaacttctctatgccttgtttttaatatctgggtaaccaagattttttaaaaataaaattccactatagataggttttaaggagtaacatttttaaatgatgacaaaacagcatatttaaaagagttgtgtttgcattttattttaattgtgttcttcattcctaacaagtatcaatgaggaaatcaataaccaagtacttaatatactgtgtttaatataactcgtaagagttgtctgaaactaaactttcttgacatgcaaacttaagttctaatatcatccctttatgaatattatcctgtgcatttggtggatacgtggagcagtgaccttcaccaaggtgtgctgacaagactaggtcacgacaccaaaggtctggcttccagttcaacttcactgttttcttatgtgtgattctagataaatttaaggtatctgagcttcagctttttcttttataaataagcccttattcaattttcttagggttttaactatcagatgctaaataaattaaaatatggaaaatactacagtaaaggtaatttatttacattaaaagtagtaatcataactatgatagtctttctggtgtgtcaacttggcactgtacatttcatccatattcaaatactaatctagcagtttctgtagaggttttctgtagatgcgattaaagttcataaccagttgactttaatgtggccaagcctgattcaatcagttggagggctgtacagtttggctgagacttccctgaaagaagaaattccatttgtgcccatgcccatgggtcctaacctgcccttcttgatggcctgccttacgaagttcagacggtttagctggccctgcaattgtataaacaaatcacatgcaataaatctcttaatatatatgtcctggttctgctttttggttcatacagtagcaatttacatggctaccttctttgtgaagaaggaatgttagaaaatatagacactaataagagatgaagcaatcacattatggaactcaaggactctggttaatagaaatcttcctcagaaagtctggtagagaggaaagctatgggaaatagtaagtcctcattcagaaatgcaggaatatatgtttacttacaagaaaacagaaattcatgaatgtttatgtgtgtctcataaagtgtaagattgattcatgggtaccaaatgatggcccagcccatcacgatgccatcccagtgctggcatcatggaaaaggcagcatgtcccttcatacaggaaagaataagggctttgaaataaaacagacgtagaatcattactggttgcctgaagttggacaggttatttaaccttgctgaagctccattacattaactttaatgtaaatatgaaataataatagttctccaaattcatgtatagtgccagcaccaaacaaacactcgataagtagtacctaatgttcccttgaaacatggattctccacaccaggcccttgctcattttctgatcatcttagtaagaaccaatactgattgacaagcatcttcagtagtggtaaatgtttactgtttatgagcattcacatatttcctacctattgtgtcatatggaaggagaaatagtaaatacccagaaaaactatcacatcaaacttcccaagttgtgtagaaatatgtattataaatctcagtgtgcttcttcctaagaagtggacctctaatcacctccactgacaatgtgtggttttctctacatcattattagacacatcaaattacagatacactacaaatagatcctataggccagtggtcagatagtgttctggcctttatctccatgttgtctccattgttattttgcctagattacttgttgattcctacctattcataagttagatgtattagaagtaactgagtgtcagagcttcccttgccctctcaaactagcccccacatgtgaatggtcttttgaaagactttgctatcctttccttctagacttttctcctttcattatttcttaatagaggcaaacacaaatagtgacctctgaggggttaatgacaaagccagagattagcaattcactgtagcctgaataaaattttaaaagcgttacaaattatgtaaatagatgcggaaaagaaggtgtcctgctgtgggagggtgaagatgatggaaataattccagcttggacattaagtcttaattaagtagctgtaggaaataaaagtctaggttaaagagaattactcagtattgtcagcctatctatccttcatgagtaagggagagtattgagaatggggaaaggaggactgagaatggaaccccggggaatatcaagctgtgagaagaaaaagagaagcccataaagacaccaaaagaagagatgaaaaaatgtgactgttttaaagagggtgtggtcagtaatgtccgttgttcctgagaggataagtcaagaaaaatgggaactaaaattatccatcacatttatcaattgaggaatcaccaataaccttactgagaacagtttccttagagttgtgagtatagaagctggaatgcaatcccttgagacaaaaatgacaggtgaagtggggacatagcaaattgtagaaaacgttttcaagaaatttagttaagaaggaaagaatgaagaaagagccgggtcagggattttagtagagcttagtgatccacgattgtgttcaatgggaaatatggcacagtttcttttctccacaagtgtagagtgcagtatttatttactaggtataatgttggaatttgggaacacttggtcttggtagtacacctgaattatctgtgaaactttgtaaatatagatgcccaagccccacctcaattctactgaaccaacatttctggggtgcagtgagtcttctttggtcctaattttcttcttatcttactggatactatatctgttgcctatgtcctaccttattgaattgttttcttctttatgtcagcactgacatactaaatgcgaggtggtacccaactctgtctgcaattgctaaaataatggtctgaacacatatctttcaactattattctattatagtagttaattcaaatgttcttacttgttacttcgcaaattgtggaaatgtcagcaatacaattttctaccaattttgaaattacgctttttttgcagcttcatgtgaataacagaaaaacactatcagcagtttaattgatagcagtttgtcttttttaaactttcattttaagttcagtaatgagattgctcggtccagtggtagttctgttttcagctctttgaagaattgtcacatttctttccacaatggttgaaccaatttacactcccaccaacagtatgtaagtgttcccttttctctgcaatttgtttgagttccttatagatgctgaatcttagacctttgtcagatgcgtagtttgtaaaaatcttctcccattctgcaagttgtctgtgatggtttcttaagtatttttaacttaattaaacttaaactcttaagttgaattagatcccatttgttaatgcttgcttttgttgggattgcttctagtgtctttgtcatgaagtctttgctagttcctatgtcagaatggtattgcctaggttatcttccagggtttttatagtttttggttttacatttaagtcttttatctaccttgaggaaggggttcaatttcaatcttctgcacatggctagccagttatcccagaaccatttattgaatagggactcctttcctcattgcttgtttttgtcacctttgtcaaaaatcagatggttctaggtgtttggccttatatttgggctctctattctgctccacttgtctatgtgtctgtttttataccagtaccatgttgttttggttactatagccctgtaatataatttgaagtcaattaatgtgatgcctccagctttgttctttttggttagaattgccttggttattcagactttcttttggttccatatgaatttttaaaatttttttctagttctgtgaagaatgtcatcagtaatttgatagaatagcattgaatctgtaaatggctttgagcagtatggccattttagtgatattgattcttcctatccatgagcatggaatgttttttcatttgtttgtgtcatctccatctctgagttctttgatcagtgttttgtaattctcaatgttgagatcttttgcctctgttgttagctgtactcctaggtattttattctgtttgtggcagttgtgaattggattgatttctgatttggctcttggcttgtctgttggtgtataggaatgctagtgatttttgaacattgattttgtatcctgacactttgctgaagttgttttttagatgaaggagcttttgggtcgagactctagggttttctgaatagaatcatattgtctgccaacaggataatttgacttcctcttttcccattttcctatgccctttatttctttctcttgcctgattgctctggccacgacttccaatactatgttgaataggagtgattagaaaggacatctttgtcttgtgctggttttcaagggaaatgtttctagctttttccaattcattatgatgcttgctgtgggtttgtcatagatggctattattttgtggtatgttccttcaataactcgtttattgagaatttttaacatgaaatgatgttgaattttatggaaagccttttctgtatctattgagataatcatgtggtttttgtctttagttctgtttacgtgatgaatcacatttactgatttgcatatgttgaaccaaccttgcatcccagggacaaagcctacttgatcatggtggattatctttttgatgtgctgctggatttggtctgcaaatattttgaggatttttgcatcaatgttcatcaagaatattgccctgaagttttctttatttgttgtgtctctgccaggttttggtttcgggatgatgctggcctcacagaatgagttgaggaggagtcactctcctcaatattttggaatagtttcagtaggaatgctaccagcttttccttgtacatctggtagaacttggctgtgagtttctctgggcctgggctttttttgattggtgtttgttactgattcaattttggagctcattcttggttcagggaatcaatttcgttctggttcagtcttaggagggtgttatgtgtccaggaatttatccacttcttcttggttttctagtttgtaagcctagaagtgttcatagtagtctctgatggttctttgtatttttatagggtcagtggtaatgtcccctttgtgatttctaattgtatttatttggatcttctctcttttctttttattagtctagctagcaccctatcaatcttattagctttttcaaaaaaatgactcctggatttgctgatcttttgaatttttttatggtagcaatttgggagggaaagaacaatgtctgttttaaaggttacttggaaatcactccctccattatcagaggccctttattgcatggttatttcctgtctcttactatccatcttcatatctagctgcagcagctgtagttcacactctttgcttgccatactgcagttttgctataactatgtcatgaccaatttcatgtagtttatatgaattctgataaaatagtttttgaattaaaaattaaaaatagatttaaatgaggaattgaaagtactagaataagagtattgataaatagtcagaaaaaatggtcaatatgccagtaaaaggaaagacaatctatagacaacagctagaaataaattgataaatgagtgcagaatatgaataaagtgtttaaaatgccatcatgtttgagaattacacaattttgcacacatctcttcagtgccaaattggctttttatcaagaaattttttttggttaaagtgttatgaagaatacaaaagtagacctgctgtctgctcttggggaacaatgagacagagagtatatatatatatattatataaatataatataaaatttatgttcttatgggaacagaggattcaaaaataaagatgtttaataaataaaacagaataaacctagagtatagatagttgattgaaaagcatagatttttaaactatcatttactgacttatctcagtctgtgctaagccatttatccacattacctaatttaatatttcaacaactttctgaactgagtcctaacttttggataggagaactgatattcacaggggttaggtaactttcccaaagtcagatagctaacaagttaattcatgagttgacctccaagctctttctttcccactggaaagctcttcagtgatggagccccagctatgctgactccaggccagtgcttatgccacagcacagtcacaccacaatttgtccccactgaattggtctaagcaaggaattttgactacagtaaatgtgcactgagttttggggcacattttgtgtgtagttgtaatttgtggttagatacttttattaagatcatcatgccctattaatttaacatcttttaatgatgtgcatcatggcctattaatttaacagtctttaataatgtgcttactgtttataatatctaagcataaaaggaaaggcagaaaattgtaaatgcacacaagaagaaataagctatcttaaactacattattaatgaggtcccttttatattgccttccaatcagcatgaaaaactgatggagccaagattcttactgtggcttatggggaaaagttgcatgcttttataactcccatgagtttctagtctccacctttagtcttatctaaatgatgttaaaagtgctgggtatccaggctcatccagtgtgttcttcctggattatcagagactgagagagcacctatgaaaggaacagtaccataggaaaagcaattccatggatctccatcttccttattgattctggttaacacataaaactgcttcaagaagttcaatatgaagtcatcctagtgtcatttgttcaaagcctaggcttatcatccatttatttatttattcatgcatgcatttattcaacagagttcatgattgagataatataaagagtagatttcaatggtgtcagggaatatgggaaaggttctgaaaggctatgaagacccgctttcaaaaaaatggagctaaaacgtgttgtataacatgattagcgtagattagactaactttagctcctctttctggtagcagaggtttcatttcttctgtattgtttgtgtgattagtttcttagcaggaatttttaatttccgtacgtggcctccaattttcctgcctccttactggtgcagtgattccctagtgtcttaataactacagcggctatgctttgcttaatgagtgtgagctttagagaataatgtcatttatgaactcttaatgagtgttcacaattaagaaggcactgaagttcaagttctttttttttaaaaaagacattttcctaatgatacagctgctattgaaagagttgataatctggaaaagacgttgtttcttctgttttacagctaaagattttctcttagcttgacaaatttaaaaagtatttgatatatattttaattgctattagaaaaaatcaaaatgcacaatttaatggtttttagttataaaaatacagaatttaagggaaagagaatggaaattatagaaaatgaaataaacataggatgtctgtctcagttgtagacttgaaaatagtagtagaagataggatatatactgtcttatcagtagaaacaatgatacttgaagcaatgtcctgtggaacatgatgtatgtggacggtgatttctaagtataacctatttttttttttatcaagcccatagcagaagtcttagaggcgtttatagcattgaaaacagtttaatttagaataaactgtttctaagtaagaggacaatggcctgcttattcccttcctacctacaagtttttacttggttccaggtgtattttcaatggagacacaccagagaattttattctatgtcagaggaggccaattacagttaagaaaagaccctaagtgtctaggagtgatccaaaacatccctgatccaaagtatgctgagtgccaaatttgaacctgacactgaagctcaggagtcctgcactgtgcagttggtaccttgactctgaggcccttgaagtcactctctgggttctaagccacagggaattaagtttataaatttctgcagcctgagtttccagcattgccaggttgggtttataagctacaaaaatcttaggattaacgttagtaagcctgatggcacctacctctgaagtgattgagtggttaggggaaaggtggctaaccttcatggattcaaaccctctcttgctgcttagtttctttctttctttttttacaaagatgtcatatgtgctcatgtgtttacaaatgtacattgattatgtttgtagatcaccatcacatcacaggtgaggaagacggtaatcgtcaaacctttgggttggatgaactgaaaataatatttagcccagattggtatataatgtatcgtaaaatgagatccctggttgttttgtcaaacaaagtggcatgaagatagtggactgtgacacttgttgagcagggaagaattggtctgaagaatgctttattgtttataatacttagtttctggtttattttattcaatgcaattgctcttctcctcagaccccctattgaaatttaaggttttaaatttgattattaagactacctcttagccactttctcttcatctcattccctacctttcagctccaccctctctgacacattcagcaccatattgcttcaccttagttgtattaccctgtataactgcctcctcagttctcacactctaccaccaaatgcacgcatgttttcggcctctgcttggatgataactactataatctcattggctaaagcaaattgctttgccaagttcaaagtcaatgaatggtaaggaacattctgcctttttagggaagacctgaaaagttgcatggcagaggtactgaatacatgctgaatacagatttgggaccaagaatccaatcaaccaagtgaggatgtatgtctttttttttttttccattcagcctgtattgctatatagtaggacttgggaagcaagtccatcagataagcaagacagcagctcagaccccgtcaatctcacaatgtaatggggaggactgacatgaagcaaccaaatcacaagcatgataattactgtgataagatctttgccatacaatattcctttttgttccgagatatccttcccccttaaaaccatttatttatatctgataagagtatcaagactgactcaaaggtcaccttctgtgtaagttgattccagctataatcctttctagtccatattctctcatttttatcaattcagattctttgatgctgtgaggagtttccttgttgatacagagttcgatagtagttgtcagattgtgccatgtgattggtctacacataactcagatggaggtaatagcggaagaggactaggcgtaaactgctgtgaatgtgaaaaggtacttcctgcccatgctaaggccttggtaaaagctagctgcaagtgtcacactctggagatagtaactgtactttctgttctttttgctgcctttctaggatggaatgccgttgaatgattcccaaaaccaacttcgcagtactcatggtatctgaaatgtattagagaggtctttcactgaaggtctggagatagtaactgtattttctgttctttttgatgcctatctaggagggaattccactgaatgattcccaaaaccaactttgcaatactcatggtatctcaaatttattagagaagtatttcaccgaaggtctccaaacaaagttaaattttatttgtgtcaatttagaggaaaattatgtttcatgtggcaccatggaagggaaataaagaggcaaaggaaacagcatcatatctcctaagggttgaaagtcattgtaaataggtgctttaattaaggttagttagtgacaagattaggacttatatatccccttttatttattaacagtttaggcagcatatattttaaggatttggccatcccactaataaaaccttgaaaccagagattaaaaaagtactgcaaaagaaagctgtgatcaggtttgtttgtttgtttctttctttctttctttccttctttccttcttctctctttctttttttttctttttgtgtccttgtcacaacaacaattttttagttcaccaattatgctttctttttattatgtctggtcatggttgaagcaacttataatgaaataactgattgtttattttaagaggaagatcagacctagcattttaaggttgacatcaactacagtgaacctcttcactgaaatgggtctgagcatgagtaccgcttgtcactgggcaagattgcagggggtcctattcgcagaatgccagagacttctatcatcctcaacccgtctattttgcattccagcaacctgagacccagagaagttaaatatgctgtttcagtgccagaatgagctagtggcagagcctggatttatttgaacccaaatattctgtctataaccagtgttccttgaatcttgtcagctttcttcaagatttcttttggcagttggaagttttagataatgacaccatgtcttccattaccaaggaaaaacactcaatgggtttaagtactaagaaaaatatagaactttataatttaaggaaagaaataagaaggaagaaaggaaagaaagaaagaaagaaagaaagaaagaaagaaagaaagaaagaaagaaagaaagaaagaagaaaagaaagaaagaaagaaggaaagaaagaaagagtgagggagggagggagggaggacaattagatgtgacctctgtggtagtacataatgtgtgggccgactgaaaagagccactcagcaatggggaagaatttcatcaaggagacaacacattaatgggaccttgaaacataggctgtatttgacacctttgtggagggcaatgggtttgggcaggaagggacaaggatactgccgggaccaagagggaggttgtcatggagaaccagagaaggcagaagcctcaaaggcaccaagaggggaatgattccaaagcttttgttgctcttattttgttcctcctatggagtcaaactatattctcttgccactctctatgtctatgtgatgatcctggcccaatgttcacctagagagctgcagggatgatgcacgccatcataacggggattgctaggccaaatgttcttgccaacatttcagtttctcaaaagaaaaaaattgagaaaatatccattattctttgttatgctaattatattcacataaacatattcttatacatgttcctttttttctagttattccatttatgctatttatttccactggatagagctgtgaattttggaaaagcaaagatcatttataatgtaaccatattatgtctaaatctcctaatattatttggtgaatacaatatgaaattatattgaatatatgaaaacatgggagataaaggaagaaatcacaccctcactatccatgagtagctactgggggccccatactcactgccaccctcatgaccttattaaatcctctaaggtctgtctcctctcttttttaaaataatcacttttctaggaacagaataatctaggatgtaacattgatttcgttccttttgggctttttcttcagggctggtattcttctgctatgtttcatttgctttctcaattcctcctgagttacaaggctttctattttctcatgtctttctggtcatctcatttctgtttgcagctgattccaaagctgttgttgctcttgttgttcctcctatggagtcaaagtatattctactctctccatcctctgtgtctaggcattacgagaaatgtgcattaccactgttgtgtattctgtatgacataggcttgaccaaacagcctgcaatcttcacaattattcttcctatggtaccctaaatgtttgcttagtgattactcaacttaaaagctgaaatccatttttgtagcaaacataagccactgggcttacatttcctgtgtataagtattcaaatcagtgctactatatgcatgcaaaataaaatcataagcttcagtgaccatcctgggtatttactaacaatatacctatgctaagtgatgagtcatgcctgggataccacatttttctcagtgaatgcattttaaataccaacagaacctagatggagattatgtttaagcaaaaaaagatttaaagtgtttccaattttctaggtgtgccagagagctgcccaccatgtggcaactcatgctgtcatagcagatggtcatcaaaggggtagcttagcacttatgactcatcccttgcactgttgctatataatttgccaagacaatgaagaaaagtctctttctcataaattcattcctccctctctactgcgttcttgtactcaatcaagccctcctattgacatatatatgtatatattttattctccttgccctttcatcttctgttctatctctagtcttccagtcattgctaaatgtcatgaagaatagacttcacatcttcactactccttaccactcaactccactatcttgtttctgcttctaacagtacctactaattgacatgatgctgctctttcagagtccctagtgaatatcctattgcaaaatctagcggcccctttcccagccctcacactcatgtaattttccagagttaaccattcattccttcccctacttaatttctatgacacttctctttttatctcttcttcttctccttcctcctttccttctccttctccttcttcttctcagtatctacttccgaccttctttttcttaacttgcactttaaatgtagaattcttggtattctctgtccctatgtgttctccctgtatgatctcagacacttctccagccattatctaccctcagatgatttgaaatttgtattgtatataccagttattttcctaggctccacatttacatatgtagcagcttgatgggcacagatgttcctctggacttccaaattcaatgtgttcgaagtgcaattggactgtgaggaagtaacacaagagcatggcctttgtcttcagatggaccagggttagatctctggctcttagttgctacaggaccttggaaaacatgcttgaacttcttgtgcagctgtaaaatgaaaactgcaaaacaggtccccaacccctgggccacagactggtactggtttggtccatgacgtgttgggaacctggctgcacagcaggaggtgagtggtgggctagcattatcacctggagctcagcctcctgtcacatcagaagtggcactggattcttatcgggggaacccactcccaatatttcaacataggttctttctattttccctaagtgttggtcagtctgagaaataaagagaaagaccacaaagagaggaattttataattgggccaccaggggtgacatcacatatcggtaggtccgtgatgcccacctgagccgcaaaaccagcaagtttttattagggatttcaaaagaggagggggtgtatgaacagggagtaggtcacatgcttcaaggggcaaaaggcagagcaaagatcacatgcttctgaggaaataggaccaaggcaaaatcagaaactcctgataagggtctatgttcagcggtgcacatattgtcttgataaacatcttaacagaaaacagggttcgagagcagagaactggtctgacctcagatttaccagggctggggtttcccaatcctggtaagcctgagggtactgcaggagaccagggcgtatctcagtccttatctcaaccgcataggacagacactcccagagcagccgtctatggaccttcccccaggaatgcaattcttttcctagggtcttaatattatattccctggtaggaaaagaatttagtgatatctcttctacttgcatgtccatttataggctctctgcaagaagaaaaatatggcttttttagcccaaccccgcaggcagtcagaccttatggttgtcttcccttgctccctaaaatcgctgttattctgttcattttcaaggtgcactgatttcatactgttcaaacacacgttttacaatcaatttgtacagttaacataatcatcacagggtcctgaggtgatgtacctcctcagtttacgaagataacaggattgagattaaagtaagacagatgcaagaaattataagagtattattagggaagtgataaatatctatgaaatcttcacaatttatattcctctgccacggcgccagccggtccctccatccggggtccctgacttcccacaacagattctcataggagtgtgaactgtattgtgaactgcacatgcaagggatctgggttgcatgctccttatgagaatctaatgcttattgaatctgaggtggaacagtttcatcctgaaactgtccccccaccaccagtctgtggaaaaattgtcttccacaaaaccagtccgtagtggttggggaccactgctataaaacctactttgcagaataactatgaatataaaatatctgaaacaaaacctagcaaattgctgtcccttaatgcatatgagatattctctatactacattctctccaatgactcttccacctattgcattcctattcctttaatcatatcatcatcccataatcatttcctcttccttctatcccaatcctcacatctaatcactggtcatgtcatgtagattctgtttctctagattccatagagtccacccttagctgtctatattttgctccttatttgttcctggattgttgcaataacaatcaaattgatttctctgttttccataaatggaaaatcaaaccatccattatttcattatcagagtttttctgttttcattttcaggaaacacagcaatactcaggttattcttcttaaaacccttcagtagctctgtgttgcctatagcacgatgctataattcctttagctgtcaatctcccttacagtgttataattactgtctttccagagtgttccctcactacttctctttctgctctagtaacaccagagttctcaatgtccctcaaacaagctatccaggttaatgactttctttcagttttgaatgctcttcttccctgataaaatgccagttactttagccaggtcttcctttttgttcctataacacttacttgaatctctgttttcattctgcatttattgtagttaataagcattttctccccacaagctaagtcctttgaaatcagactagataaaggcaataaaggtagtaagaaagaaattcaaatgctaaaggaagaaccaagaaatgtaattatgcgaacaataaggtcaatacagcaataagggcaattactgtggctatgcacaaaactttgctgtgaaacatttatcagttaagatttggttattaattcattcacttcacaaataattttggggtgaattccttgtgtttagccctaggtattgaaaagcaactaacaagactgttctggctcctactcagaaaaaaattatgggaaaatgttatatacttcaaacaaccttagaggaatatatacaacagttcattatgaaaagcaaaatttctcctggtactaaagtttgagaaaactttctcattaggaacataatgtaggggatattgagtgaaataatgtataaggttctcaataatagtcttataataaatatagaagcatggttttatatgactgttaaggtataacattgaaaatcatttctatcccctgctctacagaatgcctttacatactggggacttgctaaatagttgttgaaatcaagcactatgatctgactttgttgatcttttttcaaatactgatagatccatatccagtagtatcattggtatcttaatcaaaatggctttgtgaatttatttatttggcaccaaagaatctttgtctgatggcctatatgtattagtttcccattgctgctacaacaaattaccacacaacaggtggcttaaaataaccaaagttatcttataattctgtagtttagaagtcccatatagttctcagtgggctaaaatcaagactctggcagggctggattcttttatggtgactcaaaggcagaatctgtttcccttctttttttagcctcaagaggcaacccatattccttgacatatggcactcttcctccatcttttaagccaatagtgttgcatcactctgatcattactacatactcacattttcctctaactgcagctgaaaaagattctctgctttaaaggactcatgtgattatattggacacttctggataaatcaggataacctccccataacaagatccttagcttaatcacatctgcaaagtcttttgtcatataatatatttacaggtttcagggatccatatgagaatattggggggggggacattatttcacctgccatatatcttactgtcatgttctaatttataatagagactacgaattccaaagtgccatttcaaagaagcaaattgcaggatgtaattctacacccctcccgtaaaacaacagcaacaaagattacatttccttagaatgcatgggtacttgctatttgtgcatgtgcaacttaggacatgtgcatttttattttttctgctttttcttttttctttctttcttttttttttttttttgagacagagtctcattctgtcacccaggctggagtgcagtggtgtgatctcagctctctgcaacctctgcctctcgggttcaagctattcttttgcctcagcctcccgagtagctgggactacaggcacataccactacgccctgctgagttttgtatttttagtagagacagggtttcaccatattggccaggctggtctcgaactcctgacctcatgatctgctcacctcagcctcccagagtgctgggattacaggcatgagccaccatacccagccttttactgcttttgtaaggttagactttggaattaaaagagggtgtctgaggtgaccatgtcagaatttgctcctttacagagaacattggagatccctcttcccctctctctttctaatgttatgcatttctcgacacctgatgtagaattgataatgggttaaaagcatcttttccatttctttgactagagcaaaatgaagccataaaaatatctaccaaccctgggaagctcttgcataaatgactggtgtttattgctaatgtaaaatgtttttgattgtgaacatgctgctgtgtgatcttctgaataaagataattttatactgtatgaataatttccctttgttttccaaagtgtttgagtggttagaaaaaatatttttattatatgtctgtcagtttcactatacaaaattgaaacaatcttggaagttatgagtacaaccagatggatgaagatttccgattccagtctggaatgtgaacaaagcgtaaatgctgtttgtggattatgagttatttactaggacttatcttagaacaacgtaatcagtacctcagcaactatctagttctgcacacagcaggcactcattaaatgtttattatttgaataagagaatcattttatttgtcttcccatcaatagttgttcaattctattcttcccagtcagtgcctcatactacaattgttcatcctgtacctaaaattaatacacattcccaaatttgttacattgttttggagaatgcatgactcagcctttttgccaaatgctatacctttccagaagccttataattatactttgttaattgcaaaccacaaagctgccatcatttctttctctctctctttgtaaaaaaaatggtatcccagaatagataaagaagccatgatttatatgactctcttttcctttctgttacaaacttgtttccctctcccacaataggaagaaattattaggcagattaaaagctttccttatggaatctgtaaaagaaatgatgcttgtactcggctcccgactgcaaaggccaccaacagagtaagggatggcagaaaggacacggaaaaagagatgcaggctgagattgaatccagtgatctttggagagattctgctggctcatgcaccagtgcttgaaagttctgtgttttagtttcacagtataaaaatgtgctgaaaaacatcttagtatattgtcttttaggctcatctgggacagatatccgtcaaaggtagtgattgggctttctaagggaaggtgatatgttattccttgcaggaaataattctttatatgtcccgttccctagatagctattgaaatttgtgtgccgggctgtggagaaagtagttctgtgaaaacctgggaagaatctgattagagagtggtgaaccctccctgcaaatgcagaggaagcacaaggaagaggaaggcaatcccttcacgtgatgaccccgaatcattccagtccaacccttcacaacagagggacatttttttgcttagttatggcaggttctccatttcaaacaatttgctttagacccattcttgcccctccccctccaccttggacatcactcttttagaccttcttgtcactttacagctcactcaagccaagtcacaaacattagttttcctttgctgcacatcacaaaagtcccattcaccctcaagttaggatgtggcttctgtgacaaccctcggagccacaagccaagcccctcattgtccggggaccagttagtcatgcctacttggtttacctacctggtttgttgggagagcttgataaaataatatgtttgacatgcatggccagctccaaagtgttcttcaaagacgacagaatcaatcttctgtaaagatgattagtccctcactgtcttcacctctcagccaggcttctgtgttcatgtgagttttattatggattttctttcagaatggtgataatttagcatgacatttttaatacatatttttaagttacaatttattgaagtgtaacataaatacagaaacatacaccaatttcaagtgtgtggtggaatgaattttcacgaagtcagggtacccatataacaaacatccagatgcacaactcatgctcctcgcaattcaacaggtttctaaaacagtgtcttttgggaatccagtgacttctctacgtagtcatctatggtttccccagtatgcatggctctgtatatctttagtgagaaggtcactttctctgcaaggtgtagcctacagcctttttacggaagcaaaaatacctacaacaagtgaaggacatttaaaggattgaactccaatgtgtgcaaaatcagcatgaactctacatgtgatgactaaggcattgatcatagagagtaggagataatcatgtggggtggggagggggtcccaagcaaagcattgtcagaagctgggaaaggtattatagagacatttcttcttcttatccctcacctcaccctatactttgcaccccagatcctgttttgctgtcttatattaactttgaccacccgccacacccttctatccaggaagagttccatccggcaagatatgcagccctagttcttttcctcctttatccactacctttgcttattgctgagcttcccctgtctgctcctttcctttactgtcaatggtgcatgtctccgacttaataaaaacagccttgggttttgtatttctaatctatgggctattaatgaaatgcggcagtggtttcattcttatctctaaccaccatgagcatccaagtgccaagtgtatattgtgatcactaaattgccatgagacacgggcccacaattccaggaatgtgccatttgccataaagctatatctgaaattgctattaactctttcctctgacttcggttcttctactaggaattttctttcttatcgtaactctcctaaatattatattatccatagttctctattactagcctcatttatattgagactttttagacatttcattaagtcactcactccatgaagaccgtttatggcaaagcacctattataggcaaagcattctattaggtgcagggaaataataataattagcatgtggatcttgcttttgaaaaaattaccaagggacataggacatgtgcataaatatgtatattttaagtgaccaaaaggattgacagataatggtatggatggctgagagatgagaagtgaggagtaattccttaggactgggtggatgaaagaaaacctcatgaaggaagtgacattttaagagggccttaaaagttgggttgattttggaatatatgatgatttggtaatcttggtggtggaatcagggtgaataagagaaaagtgaagaccaaattgagtttgtataaagaacagtgaatagttaggtattgtatctgttagaaatgcttgcaggtgaaaggaatatcaacatcaaaaacaataaacgctaccaaactagctcaaactgaaagggcattaagggtgtattttgaaagaatcctggaggtattttgtcccagactgaccaccaccttcattctttgttcagggccagctttgtcatcaagggctagccttctcctcttcttccactccatcattcttagcacatcggctcttgatgtcagcttaccatgacaactcacggcagtgcagaagcacatgtccatctctaggtcaatcgctgggaaggtgatgggtttgttacgattttctgggattaactgtattcagagcccttatgaaaatagggtttgttaacaaaaggaaagatgagaaagaagaggaagaggaggaagaggaaggaggaaggaagcagaatgtggaagtgaataagaatacaaagaaaagattgaggaggaggtggaagaggagtaaggagaaaatggcttaaaacttgagttttaggggcacagtgagatcattttggctacaaagtgggatcatattatgggtaaactggtaaatcccatggtcagcttttagtctttttccttgacctcttctttcacctgttggactctgttgactcaccttccccctctgtcctgctttttcctgtgtttacttcctaagctctggctgctccttttcaaggtcgtttgctggtgtctgccctctgtttcccacataaatggcagtgctcccaggtttctgtccaggtcctctcttctcagtcctcctaaggaaacccacataaactcaacaacttgatacacattgctctcaaacctccagcacaaatctttaactgctctttctgccttggatctgcctccccacaccctccccatgtagctcagcctctgtggcttccctcaagctttccccacaccctggaattccacacactttctttggtgttgtccaacaaatcacttctcattcaagaggaatttatttcaggttgcctctctgcagtctagttcctaccgccttccgcggggttccctgtgccctccctcacctcttcagtgcctctcttcatgctcacttcactgtacctagtcactgattcaaggaccagcaactctctaggtcactccaaaaccattgcagcctgcccgctgcaggccactctcagatgccacccagatccctggaatagtcttcttatccacctccttgtacccctccggctgttctccaaattgtgctttatgtggtagcaaaatgattttttctaaacaatagtggtgtgatgactatcctctgcccaaaatctttccaagggttcctgatattctcaggagaaagacaaaggccctgacatttcatacagagccgtacaaggggcctccctcttccaccttgatgtacatttgtctccctcttgctttctctaccacagttccaccagccttctttcatttactccaaagtggcatgccatctaccttcctccacaggatctttacaaatgcttttctttgcctggaatgtctatcttctccaccttcatcacactagctgctactcctctatctgattgcagctcaagaggtactgccttgggaaagcctttcttaacatttggatccctgacttcatggagccttgtctcactcattcattgtgtttgtcattatttatgaccgtggaattgtttttgtgattgtttgattaatatctgtttccctctctaaatagtcatctctgtaagagcagcagctggggctattttgctgatgtttttattcccactatcttgtatgatacttggcatgtcataggcacttaataaatatagtgcttttagcaaaatgaactttctcttttataccatgaaattctgggaaactgagacaagcctggtttaatgctatattctgaggaccttgaagagtttttatctatgaagattgctaaaattattgataaatgattgatttaagaaggcattgtggatatcaggctaattaatttgtgattattgatggaagactgtgtgtttgtaggtgtttattgccctaaccagctaatcccagataccctcacccagtatttctctataatgttcctaatccattctttctgccccagttttctcttttaaatggtcagtgagggcctggaaacatgttctcacctctgatcagaccaaggaagcagaacttctctaatatgtgaccatggtttccctggttttgagggatttgatgttctaagatgcctccgtcttgccaactttgtagtctgttctgtttcagtctgttatttattgtgttttttcaattctcccagctgcctctcttaatctcaaattccactattctacttgctaagtcctttcatctagaagtgacattggggaaggaggcacattgaacactttcatggacccaggtcctaaatggcaatgtgtacttagcagtgaacaaactgtgttagtactgaagctgctgccacaaagaaaactgtgtctttcacctgcagggtctatttatgtgaccacatgttgaagctcaggtaaatcttcagcatcctctcatcctgcctttcctttctgattaggaaatcttttatttatcatggttttcattttctctgaacagatggtgcattaccaacaagtgacaaatgactgtcctcccaacaagtatttagaaacaaataaaattaaccacaagaaatatggcagcagggtgagtaagaagctcacaaagtaaatgagtttatcacattatttgcttccctactggcatcatgagatccacttttgaaaaatatatataaaatagtcaaagaaactgatttagacagatcagttaacctcatatatatttcctccaaacacaattattgggaaaaataactaatcttttcttgtcaaagcatttgctttcctagaagacagcagagttctgtttagcctcatgtaaggaaatagtgtaatgcattgtgataaatagatgcctcacacctttctaggaaagaaaaatgttgaggcctttgactgcaactagatggactgaagctaaatgcaactatctccgtcagcaaaatagacccagttgctgctctctcagagattgcagtttagagggggaaatagatattaatcaaacaatcacaaaaacatggtcataaatataagcacaatgaatgagtgagaaaagctccatgaagtcatgaatttgaatgataagaaaggcctcctccaggaagtgattcttaagctgcaatcagatagatgagtaggcgttagtgtggtaaaggtagagaagatagacaaacattccaggcaaaggaaagaggatttgtggccaggcacagttgctcacacctgtaatctcagcactttgggaggctgaagtggacagatacttgagccaaggagtttgagattagcctggagaagatggagaaatcccatctctacaaaaaaagatacaaaaattagctaggtgtggtggcgcacacatgtagtcccagctattagggaggctgaggtgggagtatcgtttgaccccaagaggtcaaggctgcagttgccactgcactccagcctgggcaacagagtgaaacctgtctcaaaaaaaaaaaaaaaaaaaaaaaaaaaagcataaaagcatttgtaaagatccggtggaggaaggagatgacatggaacttaggagtagatgaaagaaggccagttgagttgtggcacagaaagcaagaaggagacaaatgtgcatcggtgtgaagagagaggccccttgtagggctcaatgtgaaatgttagggccttccaagagttcctgttattctttctcctaagactaacaggaatccttggacaggtgctttcagcagagaattcccagcttactctcattgtttgaaaaagctcattttgcaactaaaggcattatgtcttcaaagctgcattctatgacatccactcatgctcagcatcagagtatgcactcagacattctagatgtgagctatagatactcgttttttttaatgtttttagataatgccactaattctgattctctgaaatatttcaacctatgagatgtgctttaaaacatacatgctttggatgaaaatgccataaaatggaaatgtgatataccctataaatagatgaaattatatataagaacatcttaggaagagggtaaaattaaatcagtaactgaaacagtaattgtaaaatattgttatatttcctcacttttcacagatacttcactgataaaaaggggaacaaaatatgagattgttagtcacatgatttccttaccgtgaacaacagttacacacttaaatgtaggctgatagtagttcaatcagagtccacacttctttgagaagttcatgttctgcatgagttagtcatggcaaagtgaataaataattcatgtgttactactccccacccttcctagatggatgtagtgtaagggatgttaatacacctaaaagcaaaagatggatattctaacttcagggatgagtgtggagctaggcggcctgttccaccgatctctctttccttctctcctgaatcgtcaacattcaaagttgcagtggcatctcacatctttgaaaacaattccaccttgatctcactttcccttcagctttcaggtccttccaccccaaaagtatctataatgatatatgagtgatatgtgattaagtattgatataatcataatccttagtttgggaattaattttcattttctcccccagtcctccctgaccaccactcccttgtccctgtcctcttccaaaggctctaccatcataatcaagaatatctccttgactgtaatacatcatgacaatattgttttgtctgggtatgttttcacaaaaacaaaattatgctacattttaagaaaagaaaattgtgctaaagagtcattctgacttaatttttttctattcaacacttttaaaactattcaagtttctacatgtattgttttaaaatttattttttagttagcaaataaaaagtatatatatttattgtgtgcaacatgatgtgatatatatgtgtatattttaatgtatttgtgatgcctacttgcagttccatagcataaacctttcacattttctcctcctttcctaaattgcctctatctctcccatgccacaaacaacactgtggtgagtatcattatgcacaccctctatcttcttttcttaacttttattttaggttcaggggatacatgtgcagtctacatgggtaaactgtgtgtcactggagtttgttatacaacttcccttactcaaaagagagaaatgtgtttagtatatacatccaggagtggagctgttatatcctaggtgtgtgattaatcaattgcaccacggattgctttccagaaacgctacattaatttacactctcaacaagaatccactagggtttctgtttcccaacatctttctgacacttggtattatttgggctctctaatttttgccagtctgatggaagaaaacccttgttttaacttgcatttatttgattgctagtgaggctgaatatttgttcatatacttgttaatcatttggatttcactataaattatatatttaaattacttgcttatttttctattgtgtttcctgtcttcttgatttgggggtatttccttagatttttaagatattactccttgttgattgtaaatctttcccagtctgtgatctgtctgtcaactttgtctaaggtattctctgttgaacaaaaagccccatttttttttaagaaaggaagtaaagtacacttggaagagagccaagctggcaacttaggagattcaagtgctaaagatcccacatttagatgtatggtttgtgtatttagcagtctcaatgttttctatatattcttctattaaccttgtagttccacccttcacatttaagtttcccctctgtatggtatgaggtaaggattcaaggttgttgatttttctttaattggtagttttctcccaataccttctgctaaacagtctaccatttcaccattgattaatggtgccagcactatcatatattaagttaaccctgtcatgtagtattttctgagttctctgtgttacaccagcagcatgcatctatttattagcaggaccttaatatgtgtgttcatatatggtaaagcaaaatccttgcttttgttctttgtcaaaataaccttagtttgttttacttgtgtcactttcaagtaagttttccaaagttctcaaaattgttgtttggtattgtatcaaatttatatgtaaacttgaggaaaattaagatctttaaagtgtgaaataatcccacccatgaacaaaacttatctctcattttacttaaatatcttttaagacctttaacagagtttttaaaatgtgctctgtacaaattttatggattcttggctaagttattccctagaaatttactaattttgttgctgttgtaaatctacatcagtagtctgtagctttctttctgagattctccctgtagatacaccaaactgtcaatttgatattttcattttgaacatctctcattacctaaaacttcacatgtacccaaatgtgcatttgatctccaccccgcttccagaatgttcccccttcagtcttctacaattttaataatagctaccactttcagctccttccagacatccgattataaatcttttactgatttcctacctaaactattctctttttcaccatttcatttgacgcctcattaagttttactttaaagctaaagttctttataaaagcagtcttttcaaaattagcacataaatatttattgaataaattataattttttttctctgattgcagaggttggtggtgacttttaggtcatggcagcaatatttttcttgcataatcataaaatataatgctgttgacgcaagtactgtttttaaaataaacttgcccttaaaatgcagtgggtattaataagaatagtataaaatatgctgttataacaaatatcaccaaactctgaaagtttatttcttactaagcaaagtctgctgtgggtataggtaactctctagggcaattgttcttcatcccagttttggtagtgatacaagtgcatggaatcttcaccatcctgtaaaaacattatctggaactcagtcttgttcattgactttgaaggcaaagagaataccgtatgatttttcattggcaatgagaagctttagatcgaagtgacacatttcacttccactcatagaccattatctggaactgcacctaactacaaagaggcagggaagtttaatccccccaagaagaatgggatgtgggagggcaccagtagtttccaccccacaatgtgtatgatcaagaaaggaaaagcaaatctgctcacccataacacaaaatccttcacgtttccttccagcattagcatattgtgttgtggacattttgttctgtcaggaccatcgattttaagttcttctgagataatatggtctacagtttgttcagaatggttctagttctcaatgtttgctttttagaattttactagaaaggagaatgatcctggagaaactatatctatatctaactagagctatacctgtatctgtatctatatatatatatctatatcttccatttcaaatggcctgggaatcatatagaatgagctgccatgactatagtcatattcagccaaggaagttaattgtgagggaaatattggagactcatatgtaactcagcaccttaagatgctcatttgggccaggcacagtggctcacatctgtaatcccagtgctttggaaggccaaggtgggaggatcacttgaggtcaggagtttgaaccagcctggccaacattgtgaaacttcatctctactaaaaatacaaaaattagccaggcatggtggtttgcacctggaatcccagctacttgggaggctgaggcacgagaattgcttgaacccaagaggcagaggttgcagtgagctaagattgcgccactgcactccaggctgagcaaaattccatctcaaaaaacaaacaaacaaaaaaagatatccagttgattccatcaatcattgaatttatgtctgattttgggctatttagttaatctctctgtgtatccattttcacactgccaagtattaatagtaatagtgcctcctccttggggtgttggaatatcaaataggataatgcatgtgaaccgtttccgtggtccccatcacttagtaaatgctaaataatcaggagtattgagaatatatgatttcatcatgatttaaacatttggtcctaacttttggcatcaagtacattagggatcaaaagattttaaaaattgttttttcctaaaaacacataaaattgctttttaaaactatgatttttcaaagttaaaaggtgagacaaaaaaacgaaccttgaaatagtttgtctgtgtatttgaggtgttcacaaataatctcagctgttgctaagacagcataaggaaacaaattttttagtgacctggattctagctcagatttctgctaactagcttcaggatttagaagtggcgttaatgcctgggtcccagttttgttggttctactatgaagggatttactaggcaatctctcagagtcattttagcactcgaattctaatactgaatagctttcacaatgtgtgaagtggatatattttccctaagggtaaaataaatgctccaaaatatttcatgtagatctttgtaccaaatttatacatagtaaaaaataggacacaaaaaagaagttggagacacagttcctgccttcagtgagcttctaataccagtgattaaattcctgacagtgttagcatattaccaacagatgaagtaaccagagacttgtatttcaaaaggtcaaggaaaagatggaaggagggttgacttgataaaattctcatgatgattcattagaatctctgaaagcagaaatctcatgtcttctgttttcatccttctgggtgctaccctgtttatacaggccaaattcactttccatgactcttaaaatggtgctgtcattagtaaatgtcacatcagagaaaacttctggtttagtgcatattttactttcttagaagctcagaatctatgatcatatactcaatatgaatgcctacaatcacagggattacacgtatagcatcttcttttggtatcattaaaagacacctgaaggagattcaaagaagaaataaaaaatggcttttaacttaaagtgatagaattgaatgctgatcccaagaaattcagccttctgtgggcatctgcatgatcattctgcatgattgcttctcctggacaaagttggttctgacaagaggccttttctcaatactaatccatgagttaacatataaaaacatcattttcaaggtataacactgctcttatattcacagccagttgcattcaaaatagctttctaagttttcagattgccggggcatcttagctctctgaatgtagccttagagtacaagactcaagccatatctcacacatagttcagcacagccctgtgcagactggccagatcagaggccttcctggaccagccaggcctcctgaggactaggaatgtgtcctgatggactcgcaaaattcctttttcagtattttccttttttttgcagactttgcttcgtatctctcatacacaaaatctgaaacaaacaagacaatccaacaaacaaacaaacaaaaaccttaaaattaactttttttgtatacattagatgtatgtcacccaccttagatttgtagcaagctggagttctgggactatgtagatatccttaaaatcctcttccttgggctgcttctcagcatgaccctgtggtgcactatttaaaatcccacagttctgacttcgttcttttcctctttcaaccttttaatactgtgtcagatttatgatacttagggaagtataataaaagattttccaccgattaaaggattcttttcaggattttgatttagttacataacaaatagtaaaaacataaagtaaaattaatttttataatatattttatctaacccaaggtattccaaatattatcacttccataggtaatcaataaaaaaagattaataacataaattcttcttgtcatgttaagtgtttgaaatcctctgtattttaacctgaaacacatcttaaactgggtgctaaatttttatcggcagtacttgaacactacttatatgtcataagatttaatttgaaaaagcagattcacaagctcaagttgtttcaaacataattaaagtatttgaaacactgaaataactacaggtttaatatctaaattaaataaaatttgaagtttggtttctcagtcacactggcctcatttcgagtatacaggtggctagtggctcccatcttagacagccaaaggccttttattttactcagatttagtgagactgtactggaaaacaatatataggtctggacttaaaagctaagaagaaatagaagtaactttgagagacaagcgaaatgtcacaaaaattattttaaatacttctaaattttgggaaaatatgattcaccaggaagtagccgacttctgcttgtatggaaagagtgcatggcataagaatcgttagaggggcccttctccatctcagatgacagctagacacagataaatggatttcagctctaatgggagagattgtttagccgtaagaaaaaatttctctctattcagaatagaaagtcatgagaactgtgtccctggagcacattgaaattagggcaaatgtgcctctgtctgggatgatttagttgcaggccttcctgaaggatagcggatcgcaccaatcgtctctcaaggtctcttcctgctgtgacgctctgattctaggaaaacccatgggtagaaaggccacactgccagctgtttccaaatgtcgtttttgcaaggacaattaatctttctgattacatgactagtgctatagagttttcaaactttttttcttttcccttgtctgggaatgtgttgaaaactgagcaagcacttagctatgaatgctgggaagctgtgaattggtggaagagtcctttctatggctgtgttttcaatgggcagtaaatcccatgtgtatttcagaggggcagacacatgttcctcctatttaaatggttttcagaaaaatgctgagatcaaggacacattcacattcaggtaaatgtagagggtgggcccatggctcccactggcaaataatcttgaattgctttagttgctggtaatgtagctgaatcatggacaaaaagagcatcttggatctggacctggattgcagcatctggctctctacaatattgtttcccatttacttctgaagattcattaatgcagagaactgaggggctgtcaattcaagaaagaatgattctagaaactggcaaacatctctggctaatgtcatcaaatatcttttttcctggataagatttagttaagtttccccctaaattgttttatttcttagtcaagggaagtctgaattcttaaacgctataattgcttttaaaacgttaggaatgagggactagaagctatcattgtgttagttgagatttgccatgaattttctggaccagacagtggtggcaatgtcagctaaattgcctggctaccccagtcctctcacaaaggtgagagtgaacagtctgcaaagagcctaaaaaggcggcagtctaggattttctctgaggttagatctcatcatattcacatataaaacatgtattaaatatagtcatatactgcataatgacattttggtcaacggcaggccacatatacaaatgatggtcctataagattataatggagctgaaaaattcctatcgcctaatgatactgtagccatcatgacatcatggcacaacgcattactcatgtgtttgtggtgatgctggcataaacaaacctatgtacagccagttatatgaaagtatagctatacaattatgtacagcaaaaatacttgataatgatagtacatgactatgttgctagtttatttactatactatactttttatccctattttagagtgtacttctctaattattaaaaaaaaagtaagtgtaaaacagcctcaggcaggtccttcaggaggtacccagaacaaggccttgttttcataggagatgacagctccatgcgtgtcattgaccctgaagaccttccagtgggacaggatgtggagatggaagacagtgacactgatgatcctgaccctgtgtaggcctaggctaatgggtgtgttcttgtcttaatttttaataaaaaagtttaaaaagttaaaaagagttaaaatagaaaaagcttataaaataaatataggaaatataatatttcatattaataattataaaataagagaagatattcttttacagctgtaaagtgcatttgtgttttaagctaagtgttattgcaagagtcaaaaagtttttaaaattaaaaagtttataaagtgaaaacattacagtaagctaaggttaacttattactgaagaaagaaaagtattgtttaaaataaatttagtgtaccctaagtgtacagcatttatagtctacagtagtgtgcagtaatgtactaggccttcacattcactcaccactcactcactgactcacccagagcaacgtctagtcctgcaagctccactcatgataaatgtcctatacaggtgtgccattttttcttttatactgtatttttactgttccttttctgtttatatacacaaatactcataatttaattacaatttcctagagtattcagtaaaataacatgccgtacagatttgtatcctaggagcagcggactatactgtatactctagatgtgcagcaggctataccatctaggtttgtgtaagtacactctgtgatgtccttacagcgaaactgtctaataacacatttctcagaacatatctcattgttaaacaaagcatgattttattgtgcttgagagagctgaggaatgcttgaccttgggccataataacacagtgagcaagtttctcaatattgaccatgtttctcaatattctttaatgacttacctaaataaatacaaaactttaaagcagttcagtcaaaagtgaatgactaggcaaacttgtaaaagtgagtaattaaataacccactgggtttcactgttgtataccagaaatcaacatgtttaggactggaatatgtttttaggagcaggagaaggaaaatggttaggtctacactatagggcgcacagcatgggacactgtggggccctccaaggtacctcagtggggcatctctggatttcttatgaccatgaagacaccagggctctgaatattgaaagaggacaagggagtaatgaacccatagcaagtgtgtatcgcgggtacaggtacgtcagctctcctttggcgtgtacagtggagcaagggtaagaagcactgagttctgactgtgatgccagtagcactacctgcagccaggttcttccaagcctcaggaagaggaggatgaattagaaatacagctgtcttatccagccttattattttacagatatttagcatagccaaaaggaattcttactgtgttgctttggtcctcaaggatgatgatgatctagtcttatattaacaataattacttttatataatattttctataatgtagagctgaagacaagactgtttatgttaatggcattgataaaaccactactctagaatcctggtcatgcatgtgtatgaaaaacaaggaaagatggaaaaaagaagtaaaaagttcaccaggctaagtccaccccccaccaaaatatatatatatatatattagcaaatataccttggccaagaaagattttaaggcaagtaattgtttttaagaataacaaacaggctatatctctgatttgtctaaagattcatgttgtcatctccaaagttttccactacagagatttatgctgtcattggatctaattatgaattaatgattgattcatttagggagtaactcgaccaaatggcagtgaattgaaaaatgagcagaccctgaaggaacacattggcagtaataactaattctgtctgctgatggcaatcagcataggtcacttagaaaatagccctggatggaaccaattactcactttcaatccacagtgagtggtttcctcagccttgcactactgacatcaattaaccctcatggcattcttcaattatttgaaatctctaggcacacccatccttctgaggtagctacttacaacatttcaagtttgttttgctttctttgcaaaggttttaagcggaagagctgtgatattttccctctttattcttaaaagcactccgctcatccacgttggttacttgtttactttgtactcactaccgagtacatcttgacattttgtaaatgaatacaggtctacacagaattcttgaggtactccggtttaatagctacactagtttgatgctctatatggtcatattaaagatgtattaattgcacatcaagattgattttgctgcagggtccatgagaaaaatcccacacaaaaccatctattgttctgtcaactctctttgaagaggctactgtggtaggggttggtatggagagacccttgaagggtaaatgatttcatataaatttcttcaattagcaacagctttataattcctgctgcgagccatcaactacactcagattagttttaatggggaaactgtgtaccaagaatcctgccacagaaccccctaaggagagctgattacatttttttcaaatgcttacacaaggatgcatacttaaaagtgaattgtaaccttttcaaaactgacatttcaaaagaaacaaatattgagtagtgggaggaggaggaggcagtagaagaggcaatttcataagtgaaggaaaggatatcagaaggagttcttgcttttggtaaatatacaaaggcattgcatgcagcaaccacctctttctcttctgttttgtacaccagcttcttgcttttcttgtccatgtgttctcattatttagctcccacttatcagtgaaaacatgcggtatttggttttttgttcctgtgttagtttgctaaggataatggcctccagctcaatccatgtccctgcaaaagaatataaatcattctatcataaaggcacatgcaggtgtctacttcttaattcagtccctgcccctcggtcgagcactgaggttccacccatggttgcacccttggttaatctgggcatactcagcttataagaccttcacactgggagtcaatggtaactgaaaaacaacccccaacttcgttacatgaaagctgaggcaagttggtctggtgtggctacaaaatctatggtaaaacttttataggtgtttgtaagattgttgttagtggttttcctatctaaagtttcaaaaattggagttaagtattcaagggctattttatagaaccatgattacatggtcttttctgtgattcagagaattacagaatacaagttacaacacggttttttagaaaacatcacattccccagtttagtgctcgtatttttgggtcatacccaggtttatgggagcggatcccatctggaagattgtatctggtacatttatgagaagcattgataatttacagtggagcagaggagacaacctgcacaatcaagggcctggaaactatggaatgagagaagggctgaaggaacaagaattagaataagaaagggaagagctgggaggaacattaataacaatgacataacacagtacacagtagaaatgtaaatatttcaagggttattacaaagaacaacaacaacaactaaaaaaaacctttggatttgacagaaaaccagttcagctgaaagacattaatcagtaccttctaacttagaaatctcccaaaatggagtcccctatagcaaaatttccattatagcaagaaattgactactgcctagtcaaggatattttggactcgatttctgcctcagagtagaggttgaactagattgcctatggatattatacatctatttacttaaaggacaacattttaaatagtagattactagtttgatttatttgttatatttgacacatgcctctcagaaaccacatcagtttccaatattatcatctaggagtgtttatttagcatcagaagaaagctgaaaatcttactagatggagaaaaataatgccatggttctgtgtaaatacagaattacagaacattagatctaaaatggacttcattgcagaagtgacagataactacccagagagttttcagcccttcctacggatacttggttagtaatgggtggagcactgtcccctgatcatctctccacttcacagttctttccacccatttggttaaggcttagcccgcagcgatcagctcagcagtaacaacaaaggtctctgacaccaccttcctacatctacccactactcaccttatccctgacttgcacccgctaaataagcagcctcaggaatccagcctgaggctcagcactaatccccagtttttgctccatcccaccatagcttctgtcttttccgcatattctcacatcagcatctataagaggaaaacctcagtctttatggtctctagactggaatcccatcatagtccccaaaccagagagagaggagctcatgacagactgcgtgtcaatcccatccaaccagcctcccatcctcagctgagatgtacaccagaatttcccaactcagtctcagccaaacgactcaacatttcagtcaaataactggcccctctattgaagctttctaaatggagcagacaaatcagattgaccattgctgtgaggtttactgtttcttctattgttgaaaataaaaaataagttatgtgactccagaggctaccagatatttatttaacattaaatggaatttgaggctaaccaaaccttcttccttagtcaggacaacagaccagataacctcataaaccatatctttataaaataataatggatatagggcatgcatttgaaacagcaaggtaacttttttaaatttgtgactgtttcaaaagtttaagggcacacattccgatataattagcagagaatttactaccattatgagttaattcactgaccctcagtttacgttcctatatttgaaatataaagaatgtttgccctttaataacactatggactagttaagaagcaatgttttagaaaatgtattattatatttatctctccaatccaatcaggacccagtaatcaacattaatcagaagtgttcatgctttatgtacaaaactgtttcagaaatgtcaagagtgaaataaatcctaaagattcttcctaggtctgacttgtgacttaataatatcaatatgaaatttgttgcttatgaaggaattagtacttttttttggtgtgtgtgtgtgtgtgtgtgtgtgtgtgtgtgtgacagagagacagagagacagaaagagagagacaaagagagaaagagagatagagattttgtgaggaaaattatttagttctttcttgtccattaaatctatttgtgtgattttataaaaataagaaacaagttgaagaatgctaaagagaagataaacactatccctgattcccacacttccagtccagttcaggcggtgatgaggctgtgtcagcatgggtggcccccaattcatggtttctctctactctcctgatatatatatatatacttggacgtaaagataggaacaataggcactggggagtacaagaagagggagggacaaagtggggcaagagttgaaagcctacctatttggtattgtgatatatatatatattatattatatatatatattatataatatatatattatataatatatatatatatgacttttgttgtagaataaatgtaacacaaaatgtttctataaggacttaaaaatgccagtttgtcactgtggtgggctttgtggttccttctgacaagcatcgaatctattccactactttctccctctgtgtagaattcatgttatttgcccagcattggcatttgtcattgtccctagtaatcttctctccaccttcttctctctctaagaagctcatagctcttagagctataggtagacatcttgtaaccaggagggcagttagcctctgttaaaagcagtgttcagaggtgaaaagaagcatatccatggtgacccatcttagacagcagacactatattccctgaaacctgacctttataactttttacttattgggccaatatattccatgttgtgtatgccggtatgacgtggttttctgttatttgcaaccacaagcttgctccctggcacagtaattattcagaatacctgggaaagggcgaggaactgagtaatatattgagtgcctacactttatatcattttatcccactaagtgatagataccattttcctaattttatacataagaaaaatgaggtatatagaagctatgtaacttgaatgaagccataggggtagaagcagaattataatcaggactctctgaaaccaaggccccttttcattctgctagacaagcagctctcaatctttttcttctttatcatccatagcagatgaggtataggtacagaacacactcgcatgggcatatctagagctgaatgtaatcctgtcctcttcccataattcaacctgtttatctgctactcaagaaagcaaatcaggatgcaaggcgtagtggcatttcttgcaggataacttgacatttctttaatttaaaaggcaaaaagttactctaaccccactgaggctgtctgtagttttacttcaaattatttttgacaaatctcactgacacattgctcccttctgcttttcattatgcttgttattgaatgaatctttttttcctcctctgctccactcaacaacaacaaaaaattcagacattgaaatcctaacaacgaacgtgatagtgctaagggagcaggcctttggaaggtgattgggacatgagggtggagccctcctgaatgggattagtgccttgtaaaagatatccagagagctagggtgccccttcccccttccaccatatgagcttacagtgagaaggtgggaggacaaccatctgagaggcaagcagcaggccctcaccagacactgaatctgtcagtgccatgatcttggacagctcagcctccagaacatgagaaataaatatttgttgtttataagccacccagtacatggtattctgttatagaagccaaacagactaaggcaatactaagtggatgtgctttctggtactttcagagcattctggagagccaagaagtttttacccatgaagaaaatgagcactcgaggtcagaggtgtcaagctgagctcttgttatctttgtataaaaaggaaaatctccacaatatatttggtagcagtactagaggcttcccctaccagttctggcaccatccagttgagatttctcctggctcggctatctgcccagctctgttgactttgcactgactcagtttggttactctaaatgtacacacccaattcaaaaaagtttgagacaccttacaataaggtcatagaacttgtaattataatagaaacaaaggggacaacagtataaagttaggagccaagcagtcaactaaggagggggatgattagattcctggaagagagtccaggacacaggttgactttgaaatgtgactcaaacaccagattcattttttttttctgcctcatagtttcaaaatctttagcaagatgatgtaataaatatatttcctacacgacttcaattacctgggttggcaaaccagaacttaatcacaactcatagtcaagtaacttttaaaagttaggtctttatcctgtgaccctgagaactgatatcttggcagttgcctggggaatcatgtgaaatcacacccagacacagtgatactcactggctctgctgctgttggttcttggatatgtgggattacttttgaaagcaacacagaaaactccttgttttcctctgcaaataaattcccctaagaggtaagaacaggttgacaatattgcattgagtcatttttctctactctgcatttcctggtacatacgtatgtatgtatttatttattatttatttatttatttatttattttgagacggagttttgatcttgttgcccaagccagagtgcaatggcatgatctcagctcactgcaacctccgcctcccagattcaagagactctcctgcctcagcctcccaagtagctgggattacatgtgtgtgccaccacacctggctaattttttgtatttttagtagaaacgggatttcaccatgttagcctagccagtctggtcttgaactcccgacctcaggtcatctgcccacctcggcctcccaacgtgctggaattatgggcgtgaaccaccgtgcctggcccacttcctggttttcagattttgcttcaactcactccctatgagtagtctgttcacattaaaaagcaaccacactccaggaatcctggtttgcataatgttcatatgttttctctctctctgcccacatcgacctttccacagatggtgtagttcagagagccacagtcgggggcctgagagaaaaaaatgcttaagcttaaaaaccatgtgtgctgtctctgtgggacacatcagcaaatactcctggccacatctacagctcaccaaagacccaatggtacctctcatgtcgttttagtacatcatggatatttggtgattatgaacattaagagtctcatgttctttcctttcctttctatctgttgtgaaaaccccacactctactaaatctttacctaacatgtctcataggttgaaactaacttacttatccctaaaacatcacataaattctgcctatatttccttagccattccctttattcttagcttaaaacttcaataatagtggtttctccgtgcctgtattctcagtagaaagccacactgggtgtcacttttccttttttaaaaactcacaattgcagcactctcatctttcattttaaggagctaatcacatgtcagttttcccaaccagactgagctcttcaagggcagggacatgctttcttttgcatccccagccgactgtctggtgcagagtagatggtgcatacattttttctgactaaaaccatgaagaaatgaatcaacccatagtgtcatttaagatgaatgacccagagatggtctgaagtaactaactgggcactcactcagggaaagggaaatcactggattatctgtactgtttagcagccacaccaccacctactccccaggcatgaatgccagctttcagctgtgcaaaatcatgctctctcctagggagtaggaaatctagatcatgcccatgtgcccagcttcctgccaagtgtcatcgtgactgcccagctccctcagatgacagtaataaagaaaggacttaatacaccttactccagcatgtctgggaaatcatgctgtcatttataatctctttggaagcacccaacagatgcattcttttgactaactttgatgtctgttcttgggttaaggctcctagtctgatgctttctttcttgaacatgctcattttagtcaggggctctattaaactattgtttgtcggtgttgtccatgagaaatgagatgaccgttgaaagtgtaccatgccatcacactgataaggactgttatctgaaggtcaaggacagcctcatggtaccagggtagtggacatcaaaacctggcagagaaaagccactcatctatgccagggctataatctgctttcactgcctatcccctgcccagtcccctaaagcttcgcaccttcatgatccaatactacatataacgtctatacttgtcctgaagccctggctgcattctaatgaatgtgtgctttgttaactacagcataataaacatgatgctataattatccatgttttcatagagctgggaagctaatctctttaagaattgatgtccctggcagacaggctcagcattttgcaattgttttgtgataatgcatggcttcatagtgggtttgttggtctcagcattttagcaatatctggatgaacaccgtattgagcacatttttatatgtgagtctgattagcagtgagtgttgttaaaatctcattgttatcccgctctgcttccaattccattctatgaaaaggcttattactggaacctgagactgaagctttccccagcagcttctggattctccccctcactctaggttaagtttacgcatggatcgagtagtgagatttgagtgactaggaatgaaaacgtccactccacatcccatgttgttgctgggcttggcactgtacattccaggactaatgagtcaatattttggacctagtacatattttcttctagaatattctttattcattcattcaacaagtcttggaatgtctgttctgtgtcactctttagacacttagatactattttcagacaaacaaaatgctctgacattctagtggtgtgggggagacaacagaaataaatcagatacatacataaaatatacaatagtggaataatgatatatgcttatgtgataaggaaaagaaaacaggaaatgaaggagtttggggaggaaactgtaagttacagtttgattaggaaaggcctcattgaaaatgtgcctttgagtaagcaccctgttaaagaatgagtatctcgaggggacacatgtaaaaagatggaattttaaccagtaataactagagctattaacagtcgataccttctggggggataatcttatagaatggcccagctgcagtggaacaaactgtagaacatagattgaggctctgtgtggtgacaccaaaaaggaagtctcctaaatgtatagtttcgcctgaagcgggcttagccccatggctgggcagggccttatgtgctcatcttctcaccccacctcctaacagggcttcaggatgcttggaccaggagaatcatcctctaaagaacatgaattacatttgggagactgagttctctctacttggaaggcccaggaaagatttccccttttttctgctgctttcttccttagtagatcttttgaaagtttcttaaatttgtaaaattgctctcccctttccttgaatctttagtcgttagctgtatacagagaaaaagtcccatgtataaattggtcgtttgtgttatattcacaggaatgggaattaagcctgaatttttaaaatgttttttcagaccctgagtaaatattagtagaactcatctaccatgaaattatggaaaacaaaattgtgataatacttattctgcaatatcatccagacttgcaagttgctagacatgaaagaaataccacaaactggaactggaatatgagggagaatgtggggtccatggaggacactgcaagtccctttctgtgattgtctccggctgacttcagacgcaacattaccatggcaacttcgtgaaaacaaggagggtaggctgagctcttcccagctactgaattttctgagtctctctctattgtctgatgatcttcctgcctgagatctcccactttttattaagcaccacgggcatgagatgagagctctgcccccggctaggcttgttcccatacgtatgttccagtgagcgtgcacaggaagcccgggtctgagttaaacagcgaccacacgtgggaaaagttgagtttcttcctttgaaggttaatgacaaccaagctaggttaaatgaaacacctgtctggaagaaacactgacaacaggcatgctcataaatagtacaggtcacccgctgagctgactctagtgcaaccttctctcgcagtgctgatattgccgaaccacgaaatcatacccaccagcacgtcatttgttagttagaaaggatgtcattttgaacatcattaaatgtatttttttcacacccccaaaaccaacataagatgaatgtcacctgtgaactgtaaaacgcatcagctgtttcttattgaaaacataacacagcggttttcatacttcagcatgcagccaaagggcctcaatggctcgctaaatcagagtactgggccccacccccagactttccttctgtaaatctggagtaaagcctgggtatctgtactaacagaattagaagaatttgaatttgttgatgctgctgcttctgggctaaattctagaaccactggtctagcagagacctctacttctccatatggctgcccctgcctgccagggaagtgcttctttcttcatggtaaaaatgtaaaaacattgcatttattggtttttttttttttcgtatagtttctgattttctgaaagctccacagaatggtcccaaagaaagtgttcatgagcagcttcctgtgaaacacaactagacaaataactctatccattgcagatgtataattggaattcaaattgatttgtgtgcatgcttttttatgagcattatttataaacttggaattggagtgtctttatggagtcattactaccattcagttcaacactaagtgattcttctttgcatccaaaattggtagagctagcagatgagcactgagttgaattcgtacactatttgtctcattgaagtactgacagcacatgccacagtccacgtgctgtttcagttatgctcatattcatgttatgttcggaaaactctctctgtgttttctattctcacactaaagcaatcatcaatacagaagaagacttctgtgaccatatgtgtggggtgtttttccccacacaccaagcagtgaacaccagctgggtgtcctctaattcaattctgactttatctacctggagacagtgtcagatctcacaggttgagggctcagtccctaagactgccctgccttccactcaccccgctaccagtcccaagtttgagcctccagaacttctgaccaccgggcttcaagttgggattcccatgatcctttctttaggctcatcaattttctggagtggctcacagaactcagggaaacatttacttacatttgctgatttattataaaatatattgcaaaggatcaagatgaggagatgtatagggtgaggtatgggggaaaggacatggagcttccataccctccctgggtgccctaccctccagcagcctccaggtattcagctccctggaagctcttggaactctgtcctcttgggtttttatggaagcctcatgacttcagcattcctacttccagagaatagggtgggatcctctaatgagagagtcttaagacccacaatcagaaagtccagggaagattagagtcctactttgggcaggtaaaaggagggccagacatcaatggcctgcctctgagtcctaatacacccaacattgtaacaaaagactgtaacaagggctatgggagttatgagccaggaaccatggatgaacaccaatatatatcctaacaccacatatgtcatatatgtatatacataagtacagaaacacacatatatatgtgactatatatgtgaatcttaggacatgtatagacatgcatgaaaaatttcaaagaaatgactctatttttggagcattaattataagtgaagccatttggaacatgaataaagaatgcttatagcatttttaagattaaaattcattttaaaataaatttattataataattacttcaaaaagcaatgcgggcaagctccaagatgacagatctctagctgaagatggatgacaagctgctttctctattaggcctgcaaaacaaatatttttaagtcctaaacatatagaacagttatggaatacctatggtgtgcatgttagccattagtttaacaataatgttaacatatgtcctttcaagaggagataggaccttatcaagtggatttattgaattacatttgctctaagatattgtctgtagaaactgaataaggaaggagttcagtagaacagcagcaagcatttcctgaatgttccaagtggtggctgtggggacacatctagtaaggcctgaggaaaacatgacaaacagggacaggttttgagaccatgaggctgtctctggaagaacctataaaatccttttgaaatatttgctattttttcttgttacctgaattaaattttctttgacaagtgaagcagttagagttcagatgggttacttgcccatattctcttaaattatattggaatactggcaataaactttagttcacttttcccaaactgaaatacatttttatatacaatctaaacagttcttagcctgtattccagcaatctacgaggccctcatggggagagaataatgatctgtggacttggctccatatcactgagaacctctgctctcccatcaggagagaaaagacagccacagttgttgaaactcagggagcagggacaggcagacatggcaacacacactgaaatgttggatttttgcatcaagccctatagcacttcaggaaaaagaaagaaaagacaaccagttaccttatgtctttactttgggatacattctgggtagaggcatattttgaataaggacaaagtactaacaatatcttggcaattaaacttaggaagaattcgctatgtaattggttgttgtttcatcaagcagggcctactctagaatttctgtattggtgtggctcaggaacaacagtgtagttagaaggaagaggttaaggactctttgaagctcatttgctaaataaaggaactgattttacttagggaataccaataaggtttaaaatatgcctttatttaaatttcacataatattctttctacttaagcagttctttcttcatgggggctggaagaggaagccaatataagttattggggatctaaagcattttacactgctgcaaggtgcccagaaagttttaaaggtttcgtaagtgatgttggtttctgttaggagaaaattcttccccagtcttacttctgaagaatcaggaagagtctcctttttttattttgactatattactccaagccacttctccctaactgcattttgttatatctagtaatgctttaatgcccccttttgtttattcaacaactctcaattagcaatttttgagcactaatgtgtagttgcagaaatatcagttatgaattctttaagaatctcagaaaataaatcctatttgacaacatgcaagaacctcatcacatgtaaaatggagctggtgactcaaagttggcatactttctgagccactttggtcaggttgcttttggaagatactgctgctcaacactggatttgcagaatctggtgcaggagaatatttactttcttccacaacctcagataaaccaagttcaatgacagtgctgcatcatttgtgtgcctggcctcacagtggatggcaactgtgattatccccagagtctggggtccatgccaggagctgcttcccctgacagaaagcaggtgtctgaacacagggaaagggaaaggaaaacagagccctgaggagctttgaaaaattctagatctggcttgatctctatacaagtactttggaaaggtagttcttatgatgaggtagcttgtttgttgttgtttttgttgttgttgagacagggcctcactgttgcccaggctggagtgcagtggtgcaatcttggctcactgcagcatcgacctctcaggctcaagcaatcctcccacctcacactcctgagtagcaaggaccataggcacccaccactacacacggctaatttgttgtatttttggcagaaatgggtttcaccaagttgcctaggctgttctcgagctcctgagctcaagcaattcccccacctcggcctcccaaagtgctgggattacaggcatgagccaccactcgcagccataaagtagctttatagttttccttaacttttcccccctccaaagtaaaccttaaacagacttccaaaagaaagtggttttaaagtgtctattgccataaatttcacatggaataatttcagccacataatcaattcttgtgggatttcatgttatcagaggattttctactagtaacaaatttcagatattccatatcactaaatatgatttcagcctctgtggtctcaggcgaatttgctgttggtctccgtgttcttgttttgtcagtatgttcctatacattacatagcactttttccacaacgagtttttcctactaccttgaatcctagtagatgactactttttctaattttgagaaattgaacatatgcaagttcatttaagcaggtaatgaaatatataatgccattgcttaccactttatccccttaccttatttcattttactttgtatcattttacatattaaataattgcctgtttgtttatctgctcccactatcctttaagcacctagaaaaatgcccaactcaggagggtcattcagtgtatgtttggcaaatgaatacttgatattggaagggcatccagttctctgaactttgaatcctgatacactatctaccaactcctgtgtctgtgtcctgaaacgtgtttatcattctcacattggtgctggaactatctgaaatgatatccattccttttgagcttgaatgcaaaattagcaacatcattttacaaatgtgacaccaggaagaattaatttcttgaaagataactcagtagaaatgatttcatcattaaggggaaagttatcagaattgcaaaatgcaaacatccaaaacaatgaagggaaactaaaggctttacctgaaacatccaaaaagtccattgtaaaactgacagaaaacaagtgtagggatttatttcagctttactgcagtgtgaaattggccatttgttatagactcttcctataaatcaccaaaattagaggtatatggtgtgcagatctttaaaaagattcagagtttcttctgatcaatcacacaaagacatcaaataacacctacactgcacctgggtggtgtttttgtttgtttgtttgtttgtttgttttgtttttgagacggtcttgctctgtcatccaggctggagtgcagtggtgcaatcatggctcaccacatcctcgatcgcgtgagctcaagcaatcctcccacctcagccacccaggtggctgggactacaggtgtgcacaaccacacctggctaattttagtagagacaaggtatcactgtgttgcccaggctggtctctatctctgggctcaagtgatcttcccacctcagcatctgaaagtgttgggattcaggcatgagccactttacctagccaggtgctttttttaagtaagcattctaaagtgtgtcagtcaatcactttcaaacaaaaggcaataaatgatctatgcattgcttcaccttgtgttaataaatattttgtcagccttacctcatggagaactgtaacactcttggtgactattatggtattttattgcttttatttttatcaaagttagatacatcaacataatttaacaatcatttagttcaacaatcatataaaaaacatcattttcttctctgtctcccattcctaatttctgctctcaaaaggaaacaatttacaactcttcttattgtttattttgtcatttacctccaaatcactcaaaaatgtgctttagctgctttctcttttttagctttatacaattcactagtaaattttcaccttgaaagagatttaacatttttcgctatcccctaccagtttcaaaccctcccactcataattaacctcctactacctacccagtataagtaaatcataatttttgatggatcagttttcagtgtttacataactatgtaagaactattcataagtgagccatgtagtgtactacatttccattcttatagtcatatcttttcatttatttgttttctacctttttgtctccaattaacctccaactctactccatagtataaattggtcaatatgttcaaacacattggctcttctataaattttatcttcttggagacatgtttctcagaaccctctggcttaaaatagagagtttagagtagcctctctagacctattcttcagctgtcatccgaagagctccctcaatcatcattttgagggtgtgtgatgttcatgtgtgtgtgtgtgttgtctttttttaataaataatctcctattgtctagatcccatgtcttttgcatttttggttcactctttattatgataaagtgtttccttcagtcttgaaaaaaaagggtgaaagaagatgttttgttttttcttagaatctatgtgtccaaaattgttttattccatcctatcattcaaatgggagtttggctataaacaaaactgtaatttcaaaattgttttcccctcaaatttttaagacactagtttgttcatgagcttccagtgttggattaaaaagtccagagccaaccaggctcagtggctaatgcttttaatcccagaactttgggaggctgaggtggggggatcacttgaggtcaggagttcaagaccagcctggccaacatggtgaaacccggtctcaactaaaaatacaagaaaaaaaaaatagccaggtgtggtggcacatgcctgtagtctcagctactcagtaggctgaggcaggagaactgctagaacctgggaggggggaggatgcagtaagtcaagatctcaccactgcactccagcctgggttacagagcaaaactctgtctcagaaaacaaacaaataaaaaataaataaataatgcaatttaaaaaagaagtccaatgctattctgatttcaaactacctgtagaacatctccttcctggcccaagttaatagaatcctctttttgtatccactgttctgaaatgtcctaacaatgtagctttttggagtaattttcattcatttttctggatgcttgtttgtgaggagaagggtcttttatctgaaaactttttcttgtgctctgagaaggtctattaaattattgtgttttctgttctttccttaaaaacttccatgattttgatattgcaccactcatcttttttctattatccatttttttgcttttaattctattttctcaaatttatcttatttttttcatctattatcttttaaatttcaagctctttttatgcatttctgatgtttctcatagcattatatctttgctttataaaggtaatctcttatttttctgaaaatataaatgacacatttgaagttgttcttaattattgttgaacttttttctccctgcaaatctttcttctttgttgctttttaaacttttaaaatgtcttttatgttaaagttgtgttttgatccctaactgctgacatttaagagtgagttaataaaaaactccattcatgtgagtggggcttgctgcctgtggacctcactgtaaatctggctagattgcttcactgagaagactcaaatgacagtactcataggtcttttctcctggtctggtcaaatccctcagagaggctctttcccctgagagtaaaaacacaaatcccagtgttctggaaccacatctgggaagagagctgagaagtggcagtttttaatactaaattcatagatttttgtgtaaccctctagctttcattatggaagctttactcccaattagctttggttgcctactctaaattctttctggatcaccatatctagagggtaagtgttccatcttctgccagaattaagaagggacagtcattctgctgcatggagtgaaaaggggtttctcaggtctaactgttctttgttttttttggataaaacaacatgatatatgtgaactttatttgcgtaactatgaaatattaaacaaatgccagattaatcaacatataagaacaaagtatactcagaatttagaagacaaaactaaacatgaatctagaaagggtaagcatataatggatgacatctctatctataacagtcatccaccataaaaagaccatttgagttcctctatcccaagtccaacaaggtaattaggtatttcagaaaaaaaaagtgactaatttgtaattactcacgcaatatttaaaccacatgttaaaaacgggatacatgttaaaacatgttaaacatgttaaaaatgggatagtgtctacccatgtacctacaatcaaacataagaaagagtcctccatgcagttaaatgttccttatatgtcattgcatgattgcccttgttctggctttgctatttgtttttcccacatgcatatatatctaagcaatgtgtagtaatttccatgttgttaagcaggcaagtattaatgcagtacactggctacctaaaaaggcagaagctagtttcagagttgccatggctcttgtatttctgatctcaggagcacataatgagacactgaagtggtggaaagaggtgccatgtaagtatctatactcataattgcaagcttgcttggttgctaaataacatttagaatgaatgtttctctcaacattcagtctctttgcgacataacccatacttgaaggggtgatctcttcaacaaaaggtatatattaaaggattcaggcaaatcatctggttgtctgagactgatggtgttgctgcctcagagttccacactcatattattttttggatcagtttttcacctgctggtttcttctagcatttcaggctactagccttcctttggtccatctagctcatagatgccctatagagaatttagaaatcattcatttcccttccatgcccacttcagaagtaacatgcaaaggaatcatataaacttcattctagtaaattatgtattcagtgtctatataaatagtgggtcagaggcagaacagatgatgttgctcaatagcttcaatgtgacacctttgagggtcccatagaagacgctataaatcactttgcagaacacctttggaattagtggaaacatagatgccaacacatcctctgaattgtctgtcacattggcctagagtgtaatagttcatgggtaccgtactcttagcacccagagccaatgctaaccttttatctgctttatatgagttcattaattattgggtactttggcaaaatctttgccaatgtgtaacatttgtaatacataagaaactgaaaatctcagattgattttctgaatgtaattctcttccactgttggcataccattttagatgtttggtaaaatataactgttatgcttcttctcccaagggtttgtaaggttgttatattatgtcttatttttatttttttatcagtgcaaaaagtaaaacttacagaaaatttttaactggagtaaaataagagaaatgtcaaagacattatctagagtcccattaatcaaagggaattgctgctaattttgtgtaactgtatttatttatttattttgagacaagttctcactctattacccaggctggagtacagtggtgcaattatagctcactgcgacctctgcctccggggctcaagagatcctcccacctcagcctcccaagtagccagaactacaggtgcacactgccacatctggctaatttttagtattttttgtacagacatagtctcaccatgttgcccaggctggtctgaaacccctgggctcaagcaatcctcctgcctcagactcccaaagtgctgggattacagctgtgagccactgaatccagacttgtgtatttttttcaacttattttatcttctttctatgagaatagaaacaaaattaaacatgctatttttaaaagataatttttgtgattgcaataatacatgtttactatagaaaatttgaaaaatacacaactatataagacatttaaacccagaattttactactcagatacaaacactttaaaactttatatttacatatttctttaaggcctcatttttcatttttaatcaaaaaagtagtaaatgcttattttaaaaactatagataacacagatttatatagcataaataatttagattcccctttcagccctattatcccctaaagttcttcaaagtatagcctctttaaagtttgttttatattttcccagacatccttctaagtgtttacaatatttgtataaagtacaaacaatccttgaacaacatggggcactgattccccttgcagctaaaaatttgcatataacttttgactctcctaaaacatattaagtaattactaatagcctattgttgatggaaggcttaacaatgaaatagtcatttaacacatattttgtacgttatatgtattatatattgtattcttacaataaaataaactggagaaaagagaatattattaagaaaatcataaggaagataaaatataattgctgtttactaagtggaagtgaatcatcataaagttcttcagcctcataggctgaggaggaggaagaagaggaggagttggtctggctgtcttgggaactgagttgaaaggaaattcacataaaattgaacccatgcagctcaaacccatgttgtttaagggtcagctatacatatttcctaagatccaaaaatacaatgcctattatacacactaacctaaatgtatgtatgcaccaaactttaaatttactgacataaatacaattatagcatacatcctattccacaacttgccttttaaatttggtcattttaaatgagcacctcttccactgggcatggtggctcatgcctgtaatcccaacactttgggaggcttgaagttggtggatcatttgaggccaggagttcaagaccagcccagtcagcatggcaaaacctcatctctactaaaaatacaaaaattagcagggtgtgtcccagctactcaggaggctgaggtaggagaattacttgaacctgggaggtggaggttgcagtgagctgagatcataccattgcactctagcctgagcaacagagcaagactgtctaaataaataaataatgaaataaataaataaatcagcacaccttctatctcactgcatataaattgatctcattctttctaaagactgcatggaattgatgtgcaataatttatgtaaaaactctccaattgacagacacttgtcagttgtttccagaattattttccattgtttactgttacacaaaacactgctgtgtgtatctgtgtacataaaccattttgcataggtatgtaaaaatttttcaatcaaatagattcctagaaatagaattattcaatcaaaaaatatacaaatgttaatggaaggtccaattgctttccaaaaaggcagtgtaagtcacaaaaatatataaacatgcccgtttcttcaaactcttactaatactgaatattgttaatctttaaacatttaccaatctgagaagtacaaaaatactggtttttattttaatatacatttctgtgagtttgagcatttatccaaacacgatcttttgcaagtagactgactgcttgctgctggttgtctgacattctggatagcagatgaaaagctacattccccagcatgcattgcttccagggcttgtcttattcttacctttgtctacaataggttaatgcgttccttgtgtgctcgtatcagaatctgaggaaaagagtcaagagactttcactacaccatccatactacaatctcattcatttcctaggcatgatattagagtagatataagaaaaatcacctatggggacaaagctaatgcagtacactggctaccaaaaaaaagcagaagccagtttcagagttgctatggctgttgcatttctgatctcaggagcacataatgagatgctgaagtggtaggaagaggtggcatgtaagtagctacactcataattgcaagcttgcttgtttctaaataacaaagcacaagtaggcacccattgtgctttttggtccagttatagcagtaattacttctcccaggttcttcaaatggcctattgcttgtgtattactttggtgaattttcactgttttggtgtcttcatcattatcactgtttggatttggaaaggccatgtcatgagtataaaccagacactatttcaaaccagaagtttctggaatgcctctggataaattattctctatgatttcacttctatttaaacataacctttaaaaatattggaaagtgtaagaaaaggaaataaaattgtagatgtttagggcttgccttacacttagaatgctgtccctgggattctgacagagggtgccaagaaagcagcacagctttaaatattgaatgatgggatttgtgccaaggtagcatatggttttatgtgaacaatgaatattctattatctcatgtgtgatgccagggaggaaagtggatttgtggagacctggtgcagctgagcctacacaggagacaatccttttcattactgttgtctatctgtggtctaaagatggattgaaagactcacttgaggagggcagacaagggtgaagttgttaatgagttacaactgtgcccaaaaaagacatcagcaattgctatgatcaaataaattttaatgacttgagagtgtctctagtgatctgtattttatgtgagctgcctggattttcttacattagcatcatggtgatttcaaccctgtccttagagagatctccactggtacatgtctctcttaactccttctcagttactaacataggaccacatctgctctgcaaatctcagacattcaattttcttctatatgagtttgccgaaagcaaagataactagatgaagccttgtgtaaaaaggactatcattaataatagtaaaaataaggttcttgcttatggtgttttaagttgactgtcaggggctacatcttgtttatttatttctgatcaaactgaaaaactcaaaggccagtaatctgatggtgagtgaggaggttagaaatctatattacagggcttcagtgatttcaaaaagtgccattgtttgagtctgctttaaaatacttgtagaatttcaaggccactatttaaaatggcttctgcccaccagctcagtgatggtcttaacatgatagatttgctcctccaacttccagcagcatttagatatcaagtgttggggtcagctgttactgggcttcaagctgtgaggagagcctgggttgactattccccattgccatattgattggcacacaatgtggcatgctatggagatgaaggcatcctctaagacagtgctgctcaaatttgaatgcacgtaacatcacctggggaccacattaaaaagcagagtcagatgttgtacttcttgatgagacacaggattctgcatttctctcaagctcccaggtgatactgatgtggatgctgctggttcacagcccgtactttgagtacacatggccttatgttttaaatcttgtaattctagctgaaggtacaaacgcaacctctgttggctcctaatctcttgccttgttcatctcatagaacctgtccactcttatgccctcctggactcctacctgcacacaagtgaacagaaattcaatttctactgtgacaaaaaggtgatctatatttcttctgaaaataccttcattcctcacaacttcaactagctagagttgaactttaataaatgaactgaaaatatattcagtattttaatgtttgaaacatacttaacattttactgaacaagagatataatacttggagcatgtgttaagaatggtagtgttgatgaaatggtgatcaaatatattttagattccaagctattacttctctgtcaggactcagtctgcccctgtccaggggcctggggctatagcccttacagagccacggctccccctgtgtcgggggtcattacgctgcactgacagccagctctgatgctttccattctgtccaggcaccacagagtcctgggcacctttaagtgctcaatgaatgttagtggaaaaaaaatccttattggaacaaataaagcaaattatggcacgtcaaaccagtggagtaaaatgtcagaaaataaaaattgtgaaaattctaacatggaaattttatattttgttaagtaaaaaagagctggatataatagtgtactttttatgtttacaattatatgtatgtatgtacatagtttataaaaatatatataatagtatatatatacaattgtaaacatggaaaatatatatatgatgaacaaataaaatgaaacattgaaaaatgaaaacataggctagtcatggaactgattattatttaacttctttataaaattattcctttttcatattacagttttcagtaagttacaggtaaagaagaagctatgataagtaatattttagcatcattaggtatcattcttgcttccctccacatgcttaatctttcaaaagcctgctctaagactctctagagaaattgaagcaaattttgaaaacatttaattaactttaagagtgaataaattttttctagattatgttcatgctctccttttactgtgaacgctatagtatttcctaaaatttgctgaaactcacagggtccttaagaaagagcttttgcctatacattttaatattttctcacccaggcactcagtaaaatgagtaatagtctgtcagtaattcaccttattaaacgaagtatagcaaaacgctcacatctttaaatccaattgttttctctgctgcacttctttttttgggggatcggaggggggcctgttccacatagttaggttatttttgtttaatttaaaatttttttttccttgtcatactgtgtaaaatttagcctcaataagaagtatggcctttcatctttctgcttaaaactgaaaaatttaaaaaggttttcccataaaaccagctagtggctgataggatcactttaaattttgcatttttacctgagaagtaaagaaatagtctgcctagaaatttgacaacaggagtccttgtaggaatagtttggctaatggcagtagataaatctctttttcttacactagcctattgatccttctcttatccaagtggacattctttctcccattcttttccctgccagtttttctctcttctctatctcctactctttttctctcttaaataatctgccttgctagataaaagttttagaattgatttttattccaaacttactaaggtgatatttacatattcaaatacatgcacgtgcatacctgaacgtgtatactgtgccattattctacactttgagaagcccaatactcatgaaaagaaaaactgagtctccctttgctcaccttgtacctctagggcctactagatcactggacatgggtagctatttgtatgtttattcaaaaaatggctatgtggattaaagtatgaatggatcctattagtgagataaaaactagttatggagaccaagttattagaaactcttacaattataatacatgggtccacatttgactgctcttttgctagcactgtcaatcatgtagctatgttaagaaacatttctctttctcttttgctttgctatttgccatcaaactatggcctttaaaaggtgtttacctttttattttcatgcctgctccccttttttcctttgataaatatgacaacacttagaagctttaattccatcttctttgaactaggacagcacttggtgtatgattctcatatgtcattctgctttatcatttggagacttatcacccttactagattttaagttcttttaggaacgtaatgatttctatgggattgtgcgcgtgtgcgcgtgtgtgtggtgggggagggagttgttgttttcagttgttgtttctctaaatctttaacagagacctataggttcctagaaaatcactggcattggctgaattgaacttggaatttgagacattctctatgaacaatgagacgcagttacattaaacagtgtttatccaaaaatggagagtagaaatgagtttaaaagagtaaagttctcaaggaaaactctctaaagcaaaaatgcagattggatttgcatgcaaataaaaagccttgagtgtatttaatgtgacccaataaaattagaggtgctacaaattttaaggaattttatagattcttgaaacagaatctcctttgttataggaaatgggaagaagagtgagtatgtacaagaagaagagttcagatatgtttttgtctggcacaaggagaataatacaaattcctagtatatttctaaatcccaactctggtgtcctaggagcactttgtaactattgatatctgccaagaggtcctgagatcacctctgccactctcttcctcctctctgccactgcactgcagtttttgtatggctgaattctttgcctgtctccttaacatgacggctttgcatgggtcctggcatcacacttaggccttgaagcagagtagagagctaaacacataaagtattgcttatacaagtcacagagtgaataataatacgaagagagaaaacttccatcaggtggttattctggaattcaagaatacaatttctatagctacattaattttttttaatggtgcttctcctaagtagataagagggaatgaagaggaacagcgggaaggaaagagtaaaagtggagtctctagtctcctgtacttcattcttaggatctacttctgtaatctgaacagtcatacggcagtagagtttttgttttgtttttggtcttgatttttagaactagctggtttagtttgaaacatcagtgcaattgaacatgatgaggagggaaattcaaggagttgtaggaattatgcctaccagtgccttagtaattattttaatagagaaacctaagaaagaatctttaaaatggagagaaattgatattgtattgtttgtatgtttggtgctggaatagggctcgcccctgacttacaaacttttgacttagcccacagaggtcagagaggacaaaacactatgttgtttgaacagttgttttgagaccgttggaaaatgagtttgtaatgggtcccatgcacagaaagcagaggtatatcattataaaaaccaaccagtcactttgttggtagttttagcaaaagaattttagatgcaggactcaggtgggaaatatgcaaaacatcttattcttggaatattggtagacaaaccttcatatcagagatatttctggccatctacattttacttatcctgcttctttggcttgattaattgctcttgaaaacacttgctatacttttactcaggtagaaaacttttctctttgatcacatttcttggcaaatgtttttgatcaaatttcatggaaaatattaaagtcattaaaaatgtgggcctttccattatgttctttatgccttgatccaggacataattcatttactagacacataactattgaatttcacatcttctgtatattgcggtgcaacacatataattgttgtgaaagttgacagtgaagacctcactgattattgtttgagctacatttacatatcatgatcagttgtaatgtttcttgttttatttccaagtatggttctcatttctcatttattttaagaaaatttattctagttaacttggttaaaagaaaaatagtactctgcttccagatcgtcactgaaaaaatactagttcataattttgccaagctattcacagcatgagtctgataatccctcgatggagagtttgatgatttctttgcactgttgatctgtcataatgcaaaacttccaaattcttcttagttaaaccataaagagaaagaaagtccaatctcaatgaacaatctattcacatctcctgttgttatggatgtcactatttaatgagtgaaggagcatccaattcttattaaactgtatcctgaatggtactgcatggaacaaatgaaaaatgaaacatgccatttctgagattgatgccagttttcctgcttctcttttgtctggtttgatatgttgaaatctcagttaatgctcttgacaagtatgtacactttcagttgccagccaggtcttaactttcacaaaagaactgctggagaagttctggccctgagaaagctgctgagataaaagccacctttcattaaaaacgccacttctcccctgtgtgtggtgtgccctaatgtgcaacaacacaatcactagaaggtgattctgaaagcagaggtagaaagaaaattgctggatccatggttggcagcacagggttacatgaagttggccatacaattgcaatcatgctggtaagtcaatatgggttgccatggagagatggctataagaagaaaaacagatggtggtagttgtggtggagacaaagaaataaaagccccaaatctccttccaagtaaaagttacatagaattcagcaatttggggaagaatgacattgtgtatgcttggaaagtttatattgctatttttatcactctagtgcagaaatgtatcattaaaatcatcacattattcacctacttaattcccagctctggactcaccccttccacttggcttgccaaaccattctccttatttcattcaactcgtgtcaatacccactttatttattactaaatctattatgatttaaagcaagattgcccactaaatatttgcattacaaattctctcaaaaagtttgtcttttctttctctgaagaaaaatgaatgtcatttaatacagatttattgtgcagccacaatatgcaaaccattgttacattccttatttatatgctatgctataaaaatagaagctgatctaggccttggattattaaaaccttgcatcttacagtacaaatagtttttccctctaatgtttacacgatgaaaatgagcatgttgtatttttatactgaacactttttttttttttttgagacagaatctcgctctgtcactcaggctggagtacagtggcgcgatctcggctcactgccacctctgcctcctgggttcaagcgattctcttgcctcagcctcccgaacagctgggattacaggcacccaccaacacacccggctaatttttgtattttctactggagacagggtttcactatgttggccaggctggtcttgaacacccgacctcaagtgatctgctcgcctcagcctcccaaagtgctgggattacaggtgtgagccaccacacctggccctgaacacattcttatccataagtttctaaaaatgtacaatttaatgatggaaactcagactttaatcactattataggagaggatttctacttttacttgttccaatatttagcattaggaaacaatatctcttgatggaaaactagatgcatgccatttcctacttcacctcaacatacagcgatgacttgtgttagtagtttcctaataaagcacatcagtgaaattttgctaccttgaaaaaatagatacttttctttgtaattccatagagggacatgtaatagaggcaatctcttacttgagattagaaacatctttggaacacttatggcctcatgatagaataatttttctgtacatcactactgttaaaaacaactgtaaacatcagatttttatttttagaaagttttacttacatcagtgagctaacaagaaactaactagttctgaacttgagcttcagtttccaagattcaaagaatgagaaagaagagacaaatcctaaaggaatactcaagctaggagtctaatagaagaatcttttaatgaagcaggaaccccaaacaactacaacttcaaaataaatttgaactagacctaacccatccccagaaaataaatcaaattgtctgcctccagtcttggttttaagtggagaaacagaaaaatttctcctgaatattcacgaaaataagttattctttacatggatttgtaaactaaattcacatcacttgaataattaataaaacatataagcaataatttattttaaatggtactaggctattggtacctcaaggcatcaggcaaacagagatgaaaatccaaaaacaaataaaattcctacctgaaattatttaaattcaaaataaatcacaaaattttccaaagatatgcttaacaataatcctggtgttgcacattagatttccagacttactcatcctacataactgccactttgaaccctttgacttatatctccccacaccccacttccacccctgataaccatcactcactctctgtttgtatgtatgtggcttttattaattctaaatataagtgagattatgcagtatttttcttttcctgtttggctcttttcacttggcataatgccctccaggttcatctatgctgtcacaaatggcagaatctatacacacacacacacacacacacacacacacacacacacacacacatgcctagctatgtgagaagatggatatgtcattttgcttgactgtagtaattatttcactgtgaatatgtatgccacaatgtcatgttgtataccttaaatatatgcaatataaaaactcccaaagataaaatttcaaagaactaaattcacaataaaaaattcagaatacataaagaaccaaggtatcatacttgtgaggtgatagaaaaaacaaatagctgaattaaatccacaaatatatttgacatagaatattaaataagtataaggtaatatgcttaaaaaatgaaagagttttgaaatgaagaaggagtaaaatgactaagcatatttgaataagaaacaaaacagaattaacagaactaagatatagtattttttaaagaaaactaagtggatagggttagcagattcaaaagaatggaagaaaaaagagtgtgaaaatatttctaaggatattatacagaaagtagtacagaaaaataagatttagaaagtataggcaattaagagacatgggaatagaatgagaagttctctgttacttactggaggtttagtaggaaaaaaagacagagatatactaggataagtgtaaatgtttaaagaggaaatggctgtgaatttttcaaaacaaatgaaaagcaacaatcatcaaattccaggaagactgcaaattaccaagaaagatacattttttaaaattccacacaaagagatattgtagtcaatcttcaaaacttcaagaacatagaaatattttaagacctgatagagtaaaagaaaacggacaaattttctccagaagaaaatagtcacttcctgctagcatcatgagaatcaagcacatttttaatatacagaaattaaaatgtgcctaatggaaaatgtctaaaagtatttcagtgaaataaacataccttcaagtgaaaaaaaatggaaatattttccatcaagagactctcatttaacaaattggaaagtatattctttaggaggaaaaatatttttcagaaagaaagtctgagagacaagaagaaatgatgaacaaggaagtggtgtatatatattggtaaaccagacactaacattgactgaataaaataatattaataatgtcaatagaacagtatacattagaaaatacctatttggggaattatggtgttctaaggtgattatattgtctttggaagaagtaaaagataatgattaacttcaaacattgataacatatatgtatgctaccttttgtagggtaactaaaaacagtaaataactcatatatatttgaaacaaaggaaaaaatgaaaatggaaaaaactgatcaactcaaaagaaggacataaagtagaaaaaaggagcctagaaattattaataaaattgaaactaggataatagaaacacaactaaatatatcacaactcaataaatgtaattatacaaaagagttgacttaaaagacaaagattctcaggtgagactgaaaaataagtccagctatataatatataggaatatagaaagtatgcaattgaaagtatgaaaaagtggtattaatcaaatactaaagcaaagcaaggtgatatagctatgccagatataatagaatttaaggcaaaaaaacattataatggataaatattataataaaatattaaatttgtcaaaaagtatagccattttgaacttatattaatctaaaaagtggcatcaaatatataaagcaaaaatcttaagagctaaaagataacgtaaaaacccaccatcctattggactattttaacacacatggtttagtgcttgagagatcaactaaagtgaaagtatgtaaaagatatatttatatttaacttaaaagttgcaaaatatacttttaaatttttttttatttcggtaggttattgaggaacagttcgtgtttggttacatgagtaagttcttagtggcgatttgtgagattttggtgcacccatcacctgagcagtatacactgtacctcattcccttcccatcctttccctaaagtccactgtgtcattgttatgcctctacatactcatagcttagctcccacttatgagtgagaacatatgatgtttggttttccattcctgagttacttcacttagagcaatagtctccagtctcatccaggttgctgtgaatgccattaattcatttttatggctgagtagtattgcatcatgtatatataccacagtttctttattcacttgttggttgatgggcatttgggttggttctacattgttgcagttgtgaattgtgctgctataaacatgcatgtacaagtatctttttcatatgatgaattattttcctttaggtagataccctgtaatgggattgctggatcaaatagcagttctacttttagctcttaaaaaaaaatgttcacactgttttctaaagtggttgtactagtttacattcccaccagcagtgtagaagtgttccctgtttaccacatccacgccagcatctactggtttttgattttttgattatggccattctagcaggagtaaggtggtattgcattgtggttttgttttgcatttccctgatcattagtgatgttgagcagttttcatatgtttgttgaccatttgtatatcttcttttgtgggttgtctattcatgttcttagcctgctttttgatggaattgtttgtttatgtcttgctattttgtttgagttcgttgtacattctggatattagtcctttgttggatgtatagattgtgaatattttctcccacactgtgggttgtctgtttgctctgctgactgttccttttgctgtgcaaaagctctttagtttaattaagtcccagctatttttctttgtttttattgcatttgcttttgagttcttggtcgtgaaatccttgcctaagtcaatgtctagaagtgtttttccaatgctatcttccagaatttttatagtttcaggtcttagatttaagtccttgacccatcttgagttgatttttgtgtaaggtgagagaggaggatccagtttcattctcttccatgtggcttgccattcatcccagcacaacttgttgaatagggtgtcctttccccactttatgctgttgtttgctttgtcaaaggtcatttggctttaagtatttgggtttgtttctgggttctctattctgtttcattggtctatgtgcctgtttttataccactaccatgctgtttcagtgactatggccttatagtatagcttgaaatcaggtaatgtgatgcctccagatttgttctttttggttagtcttgctttgtctgtgagggctcttttttggttccatatgaattttaggatttctttttctagttatgtgaagaatgatggtagtattttgatgggaattgcattgaatttgtagatttcttttggcagtacggccattttcacaatattgagtctacccatccatgggcaaaaatgcacattttaaaagtcagttatagaacaattatgaaaattgctaacattatgattcataagacaagtctcaacaaacatattactggtggtatccttttgattaattttctctattgtttttttgttttcaaattcattgatttctccttatctctaccatttcctttctcctgcacacttgggtttattttgttctttttctaggtttttcaggtgggagcccagattactgatttgaactttttctttttctaatatatgcattaattttatcctttaaatttccctctcaacatgtttaagctgtgtcccacaaacattggcatgttgtttttgctttcatacagttccaggtgtttttcttcctatagagactttttatttgaagatagcttaattagaagtgtgttgtttagtttcaaagtttgagagagtttcttgtgtttctgctattaatttccagtttgagtccattttggtcaaagaacaaactgccagtttcaattctttttaatttgttgaaatttgattatgcctccaaatatggtctatctgatatattttatagaaattgaaaagaatatgttttctactgcttctgggtagcagaagcaatgggatctagttgtttgattatattggtaattttctttgtgctgtagtatacttttttttatattaatatagccactttggctgtcctttgattgaggtttccataatacactcatttttagcctttgaattttaacctgcctatataatttatttgaagtgagttttttgtagataacatacagatgtgttttttaatctactctgacaattgttttattgatttatttaggccatttatatttcatgtgattctcaacatattaagacaaaagcctaacattttagttttcactttctgttttttctcatttgtaaaatttctctcctttctttccctgccttcctttaggttacttggacattttttagattgccattttaatatatctatagtgattttgagtgtatctccatgcatagcttttttagtggtttctctcagggtggcatacatataagagtctttcagtgttattgttttaccatttcagggatagtataaataccttatgtttctttacatctctttgcttcctcatttttataatataattgttttaaatattttcttcacatatatttggtaccacaacagatggcattatcaattttgcttccaccataacatataatttagaaagctcaagaggagaaagaaaacctactgtatttacccatatctgtaattctttctggtgtcctgttgcttcaaaatttcttatttgatcattttatttctattttgagaactctctttagccttttcttcagggtaagtctgctggcaacaaattttgtcaagaacaagtttttctttatctgagactgtcctgatttctactcattcctaaaggttatttttgcagaatataggatacttggtaaacagttttatgtttttagcaaggatttgagaaatattttgcttttcattctggcttttgtaatttctacaataaatattttgtcattcatattgtttcttctgcaagtaagctattgtctttggctgctatcaatataaatttatctgtgtttaaatttctgaagtttaattacgatatagcttgccatgaatttatttgggtttattcttgtcaagatttactcatcttcttgcatctgtaggtttatttctcttgctaaatttggggagttttcagccattatttcctcaggtattttttagccttaccctgtctcctctctttccagtattctagtgacttaaatgtcagatattttgttataataccacaggactttcagtctttgttcatttttttcagcctattttctgtatattattcatatgcataatttttattatttcattttccagttcactgaatcttttttcttttctttttttttttttttttttttttttgagacgaagtttctctcttgtcacccaggctgtagtgcaatggcatcatctcagctcactacaacctccgcctcctgggttcaagcaattctcctgcctcagcctcccaagtagctgagattacaggcacccaccaccacgcctggctaatttttatattttttagtagagatggggtttcaccatggtggccaggctgaccctgaactcctgacctcaggtaatacacccgtctcggcctcccaaaatgctgggattacaggggtgagccatcacggaatcttttctctctcctctcctttctgttgtagatcctatctactgagcttttaatttcatttatcatattttcaagttctacaattttttattcttctttatatctcccatttcttagctgagactttttattttttgttgaagatctttaatctcccatttgtttcaagccagtttgtatgtggtgtttgactagagtataatggttattgtctaaaagttttctctcttgctaggctgcccttttcctgctcctttggctaaagagagaaggatatggaggtgaggggcttttttgtttgcactcattgacatttctgagttaccaattttacctcttccaaatgtgagttatatgcagcaaaaagaaaacccagggaaatcatcacctcatgattcctcaggtagctggatgttttgccatcttctctccactttttagagttattttgtgtttattgtatacatgatggttaaagtttttggatgtacttagcaagaggactatagaaaagcatgtctactacatcttcctgcaggtggaagtcttctctgtattttgttgagtttattcctataaacttgctactgcagatttaaaaatccatgaatgaggcacaaataaaaagttgtctgtataccactttataaactccacatgtgtttaataaaatatttaagcaatgtaggaattactctaaagcttcggggagaggccatactgtggtgtaaaaatctgaaggaggtcctcacgttcgttccaataatcactagttgtgtttcttcattgtggtaggtgtttcttcaaatctctgtaaaattagggcaaaaatactcacttcatagagtttctaaattaggattaatgagatactgtacataatgccaaccacaaaataatgatgggcaaatactaacacttcccctagctttatcagaaatggaaatagatttgtaaaaacatgagtctttattttactttaaaatatggggcttgttgaaacataggtcatagcattgtaaatatgtgtttttgtaatgttaacactttcagctaaagtgtggaatagtgattaattacatttattgcctataaaatcatcagaaaagtcattattcctataaagaaacttacaaatatggattcttcctggaagcaagaatgagggtgtggctgagatgaaagctcagggtgttgacagtgtatctccatatgaccacctgcatcagaggtcaaggacttaacacttagatccctgtcactagcagagaagccaggagacagagcatttgatagcttctgttttatttagcctctttatacacatatattctttaaaaaccttgaaaattaagaggctaatcaaactttcaaactttcctggtccttcaagaaacattccaatgtccacagagtatgagagcatgatgaaaagaaatgagtgtcccttgagagttgtttaaaagtgtttgtcccttgagatgttgaagagtaaaaacacccacataaagttgacgaagaccgtttcaccaggttaggtcacagcttttcattaatgataaatgtgaagaagaaaaaaataaaatgcaaggttacagcagaaatacttctatctttttctaacgttttcattagttctacaaccaaggacacattctactgtcagtggtttactgcaactgtcaatggtttacctttcccaggatatgaacagaaatagagtactcaagaagctgctacgtatttaatttagggtagcagaaaaaaggcaaaaagaaagataagtagttgatggtgttaacctactttaacaccatcaactgtgtgttacttaagcgtttcttgtacatgttgattttcaaatgagagtcacttatctatagcataagtactttcacacgtacaaggggtttttttctatatattattttctaaagaggaaacatttaatttcgtttccaaatgaaatatctagttcttgctgaaaatgtgtactttaaagagactttttaaaagaagaactccttgcaggtggtctctatcacaaataaacatgagaaaaggttcttagagaaacttttggcccgtaaccctgtctcctgtcgtctcatgctgggttgccatttacgtaaaaccactgtgggagtcttaaatgtcatggtagctgtgttcctgccagcttgtttgtgggattgtgtgggtcacctatcctaggggctcaactttagtgctctcaggttcattatggctccactggagagttgaaattcaatctccaatcactgttctgtaacaaattggcaagttgggcttttgctaaaatggctgccttattcctggcttaagctatttgtggactataactgcattttttaagggtgccttttgcatgggagttagaaggaagaggagttaggttttgggacaatttttggcagaggaaggatacttagaagctgaatcaaatgatgaagtcgcactctttgagatcaagcaatatccttgagcaatattgacagattgtttccttttgcctattttttgtgacattcttacctaaagcattattgtgttagtataagagaaggaatgagagtattcactccctaaatttttatggcatgatttattttatatctatatcagtgtctttagtgctgcttgaaaacaagtataaaaacccttcccttggcaagaacctgttagtaaaatgtaagattattttttaaatatgtaccaccaaaggaaatatttcaaatacttagttatgagaacctcatttcccagagttaagcaccatagcttgaaactctttatatttagttaagctaactgggttgatataagagaagcagtgattaaaataatctctcacagtgaataacccaaaagttatttttagcaggctttaggtttctctacaggatgttatgtacccaatctgcagctattgtttgagttattctaattatatttagtttaatgtacattaagaaaacacttgacttctccatgcacacactgacagacggggaggagagagcttccaaacctagtattgagctctgcagggaatttcaaaactccttgctttgagtcacttaagtgcacaaccgtcaggcaaaccatacacactagattttaatttgccttaaatcaaaggacagagaaagcccacaattggactctgtaacctgatgctgtgtaagaccttccatagggattcaaacacattagcttcaaaacggtgattttcttccctgctttcaatgattgtaacatatccatccaacaagttctcttggtcagtgtgaagacttaagcagaattgacctactttgttcttcacttcacacaaatgattgtcctttagatactaattttaaaaatattaacacaaggtccctcctctaaatccctttggccacagtttgagttcacatccatgccatctccacctgctcactgcaataccttctgtcttgctccctaccctcagccagagtcccaccctcacccccactacctccccactctcattacagagcaagatcaaaacagctccaaacccgaccaggcatttttaaagaataatgctgtttatgaaacttctttaagcaagaaataaatcctttaatggtttcccagtacctgcaaggtaaattccgaagtctttaaccacgtgcatcttgcttttcttttctccttgtgaggcacattccaccatatgtgttctacactggagttatacaaactccaattcttggcctgcccatttttaggttggaaaatcaattcagtaggtctaggccagcattatataatcaaatataataaaatagaacagaacagagcaggttatggcacacataataaagttaaccattgcttcttgatgttttgtttcagtatgtatgtggtagaagatgtaaaatgtattacctattgtgggtggacacacaaacccacacacacacggagaaaatctgtttttaacacagataatttgagtttgttggctaaaatatttagaaaatttagaatagcaataatgtttaaataaccaatatttcaccattcagaggtaacttagatatatggatttaatattgtatgtttccatacacacagctgtacacatacatgatttatatgcatagctacacaagcatttcatacacttggaaaatctcaaaatatttgttgattcaatgaataaatataaatttcatgttattaactaaaatcccattatacatacacatgattttttcctacataaagtattgtgatcagatttttatatcaatacatcttggatatacactattttatgggcatgtagtattttatttttttgatatatcaacatgtacttttattatcctataatatcggacacttcatttccaagctctccctttataaacatcattttcatatcattatataagaccaaacatgtccatatgtatgtatgtaccaatatatatgtatgtgcatatgtatacatgggcatacgtgtgtgcgtgtgtgtgtgtgtgtgtgacagagagcaccaggcatggatttaaatgccttatacatattaactcatttcattaccaaaacaacaactaaagtttctattattttcctgattttacagaggggaaaccgaggcacagagtttaaggatgttgctcagggtcacatttcagtataaatggcagagccaggatttgaaacaaaatggtctggcccaacagtctgaatatctcctactacataatgttgcttctacaacttgtgcaattaagaaaaagacttgaaagtggatttaaatttggtgaaactaaaattgaatatagatgctacttcacttgtgttggggttatgtcctgataaacccattgtaaattgaatatattgaaagtcaaaaatgcatttaatacactgaaccgaacctactgagtggtataacttatcctagcctcccttaaatgtgctcacattagacacttaaattaccctacaattaggcaaaataacctaagacaaagtttattttataataaagtattgaatatcttgtaatttattgagtgtctatactataaatgaaaaacataatggttgtataggtactcaaagtacactttctatgaatgcttgttgcttttgcccactgtaaagtcaaaaaatcccaagtcaatccatcatccttgtaaggcagaggctatctccatttttaaggcatttatttcagaggcacatcagatactgcatggcttatggaaatgctttgttctacctttagctttcattgttctgcccccacctttttcttctggaatacctttgaccatggcttgagaatagtgttcaacagcagcctctttgtaaaggtgccttgaatatgcttgtcttctcaggcagaggttaaacacctttattctgtgttcctttggctctttggacacccatttactatagcatatataatattttattataattatttgctttatgcctgtcttctccaccagagtaagaactaactcctccaaccaagaattctgccattcacctttgtactcctagtgcttacctcataattaataaatgaatgagtgaactaaagaaagaaaaaaattaattaatggctttatatttataaaaccgaatctaaaaggaaatagtgaattatattctaatggttggagcagaagtatttttaaaaatgttttatgtttgcatcacaatctttccacattactttaatcatatatgtaaaatctttctctccatctagtcatctgttatcatttggttttcataatccctgccaccacaaaacataccatactctggactccagagacaccagctccaacttttttttcagttgattcatctttaaagagtcagagtatcttgaatttgatgaatgtcagtagagcagcttgaaaataaaaatcactgcataagtgctgaatgttactattgatcattaagtatcactagacataactcaaatgattttccttattatagacatgaaagttatttttctaggcaaagaaaaggaacttattcataatattttaatctcaaatggggcattagtagtatataggatatatatactctaggatatatactggaaatctttgtcttttcctttctgttacgctttgtggatatagctttataagtacttctgtagagttaaggctatgtttctttatatcaaaattcttatacctatattacaaattttgaattataatgctacttcaatgaatttttctggaatgaaaacttccagtggattcaggatggtgtgggagaagtcctggtcacctaagtaatagggttggtcctagaaggagtggaacagacagtaacattagctcagatgtggttttctggggttggaagaagaaaaagagagactcaagattcttcttagactggtcagggccgggctgagatgtgcatacatgcccactagcaggcagggtaccattaacaagggaactccgaattgacagagcaagaagaaatggtgtggtaggcagaatattggtcccaaagatgtccatgtccgaatcactggaatgtgttgaaattttactttacatggcaaaggagaatgcatgtcacagatgaaattaagtatttagctgttctggaaattgaaagttttcctaaattatccaaaagggctcaatgtaattataaaggtctttataagtgaaagaaggagacaggtgagaaggaacagaatgatggtagcatgaggactcagcccactgtggctggctttgaagatagtggaagagggccacccatcaagagatgtggggaacttctagaagctggaaaagttaaaaaaaaggaagtctcccctatggcctccagaaggaatgcagcccttctgattccttgattttagcccattgagacctgtttcagattctggactacaaaagataataaagtaatataatattataaagtaaaaagattataaagtaataaagtaatataagttttggtaatttgctagaacactgaaatagcaacaggaaataaatacactactttttctacttattgaatgccatctatgtttttcacatgtgtatcaaattaaagattactgttacctgcttttgataaattgaaggttgactaagatagcacagctaataagtttctgaaaagtgcaactttccttttgtaaacacttgaggaagaaattgccacacctagatatgggtggggtggagaagaaagaggactaaatcatgaaacacagcatcatgcatcctatatttcttcctacattttatgataaagcttatttctgaatttaaactcattaaacagtatgcattttgactgcatgatttcagagtggtatggtcagagcataaatacactaagtcccagctctgagtttaattagttgatcattctgagtatcttcctatatctaatagggatagcatcagattagattaataaatataaaaaattgaagtgacaaatattgtcatatacatagtattactgttttgtaggctttagaatatttctttaatatatttgcctttttcgacacattgaaaattttgcgaaatcgttttcactctgccagttgatattctgagtcagtgcacaagaaaaacaaaagactttcctgagtgaatttgtgatacatagatgtccttcacatgcactttttcagttcatcaacttccataaatctgtctatttgcaatgtaatattcattcctcttttaacagaaaactttccttaagatgtgatccacagttccttatctcttaaaataaaatagacttgccgcacaacatgtagctgttttctgagatcccatattgtttgcctggcaaagtagtttacatctttattattgaattttaaggataggaaatccccatttcacttcttgagatatagggactaaaacacatataaacagaattcaagtagccttttcaaatattctggagacaattttttcacctagaagagctagttcaaggaacaacctagacaatcacacttgacattaaggaaagtactcttccactgagcatgtgcaattccacctcacctagctacataagcactaatgatcattcaggccaccagggatggtactaaaaaccaagtaacaggaaaaggaggtgatatatcagactacaactgtctgttggtcgaactgcatcacaagcattacaaatatagaattcctggatccatctcaaagtctatgttcatcctaaggcttattcacctgcctgtagacacatggaaacttctccagagtagctctgtctagcatagtggcaagtctccaggttattaggactctgtggtattacatgatgaagtaggatcatgatacaaatgctattgagctttttttcagagctctgaaaataatactctgaaattacagtttaaaatataaaactgtacttggcctaacgcatgctgatgtacatagaagttgggcttcatcaacctcaagcatgaaaagtcccttgggagttgaatagataggagagtttagagctaagaatgtgttagtggagttgaggcatatgtgaactttccagacataaaaaagactacttcaggctgggcacagtggctcatgcctgtaatcccagcactttgggaggctgagttgggcagattatttgaggccaggactttgagaacagactggccatcatggtgaaacccctggtctactaaaaatacaaaaattagccaggcatggtgactcatacctgtattcccagctgctttggaggctgaggcaggagaatcacttaaacctgggaggcagaggttgcagtgagtcaagattgcaacactgtactccagtctgggcagtagagtgagactgtctgaaaaaaaaaaaaagcctacttcagtaacccaagacttatttgaaatggcctaggaaataccaatttagctaatatgaatgatatttagagcttttaaatcacactttaaggaaagagttgattcttcatgattatgaaatatttatcacatgaattcctaggctagagactacacacaagagagtagcagtcatacaatacactttaatttattttgtgaaagtatcgtttgatcaaatgctttcttaggattctgccaatatgtgtgaccctgttttaatctttttcattgtgtctacctgtagtgaacagtggaaaaatccaagtggaatgagagtaaaaggcagctcactttccttattgtgaagttgaatctccaggggtactcactccacaagaatgagccttctttcttagctcttctttgggcagatgcttatcctatagaccagtttggtcagataccaaggaatatatttagtcacctgaagttttcatagctctttagttttatgtgtaaattaatgtttacaattaagaataagtgttatgaacaattatgaagaatgccacatgaagcattattcatcatatatgggtgtattaatccgttttcacactgctgacaaagacatactcgagacagggcaatttacaaaggaaagaggtttattggacttacagttccacgtggttgggaggcctcacaatcatggctgaaggtgaaaggcacatctcgcatggcagcagacaagagaagagagcttggggagggaaactcccatttttaaaactatcagatatcgtgaggcttattcactattacgagaacagcacaagaaagactcgcccccgtgattcaatcatctcccaccaggtccctcccataatatatgggaattatgggagctgcaagatgagatttgggtggggacacagagccaaaccatatcatttcacctctggtccctccaaatctcatcacatcttaaaaccaatcatgcctttccaacaggcagctcaaagtgagctgccttttactctcattccacttggatttttccactgttcactacaggtagacacaatgaaaaagattaaaacagggtcacacatattggcagaatcctaagaaagcatttgatcaaacgatagtttcacaaaacaaattaaagtgtattgtatgactgctactctcttgtgtgtagtctctagcctacgaattcatgtgataaatatttcataaacatgaagaatcaattctttccttaaagtgtgatgtaaaagctctaaatatattcttattagctaagttggtatttcctaggccatttcaaataagtcttgggttattgaaataggcttattttttttttttttttcagacagtctcactctactgcccagactggagtaaagtgttgcaatcttgactcactgcaacctctgcctcccaggtttaagtgattctcctgcctcagcctcccaagcagctgggactacaggcaagagccaccatgcctggctaatttttgtatttttagtagaccaggggtttcaccatgatggccagtcatgaggttggttgccgtggtcttggacagctccacctctgtggctttgcagggtacagcctccctcccagctgctttcgtgggctaatgttgagtgtctgcagcttttccaggcacacagtgcaagctgtcggtggatctaccattctggggtctggaggatggtgaccctcttctcacaactccactaggcagtaccccagtgcagactctgcatgggagcgccaaccccacatttcccttccacactgccctagcagaggatctccatgagggccccgccactgcagcaatcttctgctgggcatccaggcatttccataaatctgaaatccagacagaggttcccaaagcccatttcttagacttctgtgcacccacaggctcaaccccacatggaagctgtcaaggcttggggcttgcaccctctaaagccttgtcctgagctctatgttggctccttacaccatagctgaaacatctgggacatagggcaccaaatccctaggctgcacacagcataggaaccctgggccggcccacgaaaccactttttcttcttaggcctccaggcctgtgattggagggactgccatgaagacctctgacatgccctggagacattttccccattgtcttggggattaacattgggcttctctttacttaggcaaatttctgtagctggcttgaatttcacctcagaaaatgggattttcttttctattgcctcgtcaggctgcaaattttccaaacttctatgctctgtttccctttcaaaactgaatgcctttaacagcacccaagtcacctcttgaatgctttgctgcttagaaatttcttccatcagataccctaaatcatctctctgaagttcaaggggacaaaatgctgccagtctctttgcttaaacataacaagagtcacctttgctccagttcccaacaagttccacatctccttctgagaccaccttagcctggaccttgttgttcaaatcactatcagtatttttgtcaaagacattcaacaagtctctaggaaattccaaactttcctacatctttctgtgttcttttgagccctccaaactgttccaacctctgcctgttacctagtttcaaagtcgcttccacatgttcgggtatattttcagcaacacctcactctactggtactaatttactatattagtctgtttccacactgctgataaagacatatgtgagactgggcaatttaaaaaggaaagaggtttattggatttatagttccacatggctggggaggcctcacaatcatggcaggaggtgaatgacacatttcatttagtgggagacaagggaagagagcttgtgtagggaacctcccctttttaaaaccattagatctcatgagacttattcactatcatgagaaaagcacaggaaagacctgtccccatgattcaatcatctcccactaggttcctccaacaacgtgggaattatgggagctacaagatgagatttgggtatggacacaaagtcaaaccacatcaatgtgtcaataagaaacattgtattttaaaggcactcccatttgtctctatatacattgcttgaggatgaaataagcaagcagggacatttcttgcgttactgggagtataggtagttaatgcggggcatggctaatgattcatagacttgcaggaaatgttattttcaccttggagcctcataagaaaacacctgactctgcaggaagaattttaaaacatgccccttcctccttgccatgacatacaaaatatagacacataacattcagcccattccaacctctcttagatatacttcatatggtcaaataacactaatattttattcaataaccatactgaagactttgaagttttttacaatttgattcttaaaggtgtaatctaataaaacagttataatgactgtgaaatatttttcatgcagcacctagcatgagctagggtttcattcctcaattgcaactacaatgtttcctgtgctgtgccactcagcaaggctatttcaatggtttcttcaatatacatgaaaatcatgcctcattttaattttttggtatttttgaaccatgctttcgttatgtatatgatttggtttcttttccttcttacttccctcctctcctccttctttctttcctgccttcttttcttcctttttattaagatcctgattgcctttactttgtaactttttaatacaagatatttattttcatcctattctttatagtgtacagattcttacctactttagctttcttttagaaataattccactgttctttttttaagtgtctaagattttcaagttttattttattttgttcattctttttaagcttttaatttttaattttgtgggtacatagtaggtgtatagacttatggggtacatgtgattttatgataaaggcttgcaatgtgtgataatcacatcaagataaatggggtatccatcatctcaagcattcattcttgttgttacaaacaatctaattatacttttgtagctattttaaaatgtacaattaaattattacttacagtcaccctgttgtattatcaaatactagaccttgttcatactttctatttttgttgtactcattaacctctccacttcctccaacccctactacccttctcagcctccggaagctatcattctgctctctgtctccatgagttcaattgtttttatgtttagctccacaagtaagtgagaacatgtgaagtttgtctttctgtgcctggcttatttcacttaacataatgacctctagttctgtccatgctctggcaaatgacaggatacaaatgacaggatcttattctttttatggttaaatagtactccattgtgtatatgtgccacattttctttatcctttcatctgttaatggacagaggttgcttccaaatcttggctattgtgaatagtgctgcaataaacgtgggagtacagatatcactttgatatactgatttcctttcttttgggtataaacctataagtgagattgctggatcatatggtagctctatttttagttttttgaatttattttatttagtttattttaacaaaaataacaaaattggaggaatcacattacctgacttcaaattatactacagagctatagtaactgaaacagcgtggcactggcataaaaacagacacatagattaatggaacagcataaagaacccagaaataaattcaaaccgttctccatagtggttgtaatgatttacgtttccaccaacagtgtacagggtttcccttttctctacacccttgccagcatttgctattgcctgttttttggatataagccattttaactgaggtgagatcatatcttattgtagttttggtttgcatttctctgatgatcagtaatgttgaccacctttttatatacccgttggccatttatatgtcttctttcaagaagtaactcaaaaaccatatgatcatttcaattaatgctgaaaaggcatttgataaaattcaacatcccttcaggataaaaacctttaaaaaaaaaactgggtgtagaaggaattacctcaacaaataaaagccatatacaatggaccaacagctagtatcatactgaatagggagaaactgaaagtgtttcctctaaaacctggaactcaacaagcatgcccactttcattactgttattcagcatagtaccagaagtactaactagagcaatcagataagagaaggaaataaaaggcatcaaattgggaaggaagaagtcaaattagccttgtttgcagatgatatgattttatatttgggaaaacctaaagactccaccaaaaatataagaactgacaaacaaatttagtaaagttgcaggatacaaaatcaacatacaaaaatcagtagcatttctgtatgccaacagcaaacaatctaaaaaagaaacccagaaagtaatcccatttataatagctacaaataaaattaaatgcctaggaattaaccaaaaatgtgaaagatctcagcaataaaaactataaaacattgatgaaagaaattttaagaggacaccaaaaaatggaaagatattccatgtttatggattgaaagaatcaatattgttaaaatgtctacactacccaaggcaatccacagatctgaggtgctctctaccaaaataccaatgacatgcttcacagaaatagaaaaaacaatcttaaaatttatatgtagtcacaaaacacccagaatatccaaagctatccttaacaaaaataacaaaattggaggaatcacattacctgacttcaaattgtactacagagctatagtaactgaaacagcatggcactggcataaaaacagacacatagattaatggaacagcatagagaatccagaaataaacttatatatctaaagtgaacgaattttttgacaaagatgctaaaaccataaattggggaaaggacaatcttttcaataaatgggtcagggaaaactgagtatccatatgcagaagaatgaaactggactcatatctcttgccatatacaaacattaaatcaaaatagatttaaggcctaaatctaagacctcaaactataaaactactagaagacaacactagggaaactctccaggtcattggactgggcggatttctttaggaatatcccacaagcacaggcaaccaaaccaaaaattgacaaatgggatcacatcgagttaaaaagcttctgcacagcatagggaacaatcaacaaagtggagggacaactctcagaatgggagaaaaaaattgcaaactacccatctgacaaagggttaataaatcagaatatataaggaactcaaacatctctattaaaaaatctaataatctgatcagaaaatgagcaaaagatgcatttttctttaggtctgctgatttcaccttctctggagcatcttactgcctttagattttctttatttctctactttttttaaaactcaagttctgtaaaggtctcattcattctcttcgcttgggcatctctgcagagatcctctttcagtcctctacgcttctgccctcatctggaccgaatgctttctatttatgctacattacaatttagtgacttccttccactgcttttctgaatcacaaccactgttttctaggtgccatattcagtggtgtgcaggtaaaaatttaacataggttctcgaaacatgcatataaacaaattctaattttcagcattttctgatttccattttgcaaatattcccatcatggcagacatcaagttcccaacttaagttcactgaccatagaatggggaagggatgcctcctgccccctcaaccaaggctagcatctccccaacaccacagattagagccattttaacagagatatttctaaagaacattcatccattttctgacttaacaaagcaacttggatataatttcatcttatttggggtctctgggtcattattataaatattacagtcaagggcaaaaagtggtgtctctagagattatgacatttagagagaaaatattagccagtaaacaaaatggctaaataactaaaatggaagttagatagaataattaggtaaaaaatacaatggtgctttgtttatttttgaaggcttgttgtttttagttaccttttcaaatttataatactcaaatctagttttcacagtttgtttagttgttacagctgcccttctctgtattctcgatatgctcccttctctgtttttcatgactttttatttgtgctcttatttcttcccacctcaattcatttttttaagttctcagggaataaatattaataaatagagagagtgccttgaatataaaatgcatattttctcataagtggcattaatttggcttccctttcattacctgtgttttctttaatatcataaaagagaatgttatccatgcatctactgacagaaaagaaaatgagtttttctctttgaaagttcaccttaaagctttttgtcatgcacaactgctttaaaatagcgtgggtgtttttttgttgttttttttttggtttttttttttgtttgtttttctgaatgaatggcctgcagctgctcttcagggtttcctttttttttttttttttagtattttagttatgtttggacatttaaaaaatacatatttgtatcactgatggccctataaataaaatgctgcatagaaaagttcccaggaactaatttttagagaaaggttcctggggactaattagagtcacaagcagagacaagcaggaggttgaaaacactgtgttgcttcttatcttgctctgatattttgcgttttagccatgtctgaacatttatggattcaagagatgaatcctgaatgtatcctgaatcatatcactccatgatcaggaaatacccgtgaaatgaatgtgggtctgttgtggttttctttaggcttcgctctcttctcttttccgccaccgcttgctgaaggcaaatcttaaccaaggtaaattcagcttactggatagaggacatttctttatgtccaaggaaattaaagctattcaagcatacacctgccacataactagaaaaatacccagggagccattttcatttcaaagctgcagtttccagtgccatcagtatggctaatcactggatcattttattagaattactattttatcaatacaaaactagaaaaatgcctgaaaagtataatgatttgtgtccaaatacagcaggtgatattgtaaaatttttcaatgtagaatacaagaaatactgttagaacataataatggcatttttggtattcactggaccatatgaaatgcatctgtttcatcataaattgttgtgtatatattgacacactttataattgttttaaaatgtagatgtatgtaatacaaatataataaactctggcatgtctaaaattgtaatgacctcataatttctgtctggtattctaaaaggatgctatctaatccaagataaattttcttgtaggtatatgatctcaataaaatgtgattcaagggggttaactctagttttagatcagagtcttgagcccagagtaagtaaatgagtaagcttcgttttgaacaggtggttagtcattatcaccactggcaatcttaggaaaggaaaagaaagagacaagatttggctaacgtatatttcacacaagaaagcagggataggtagaaggttttttttgttttttgttttttttccaaaatggtactagttctagtgtcacaagcctggagttctttgtttttgatccaattatgttatactaagccaatcgttttattaaaaataatgatatgaaataagccaatcacagaaagacaaagttcacatgttctcccacttatttgtgggagcaaaaatttaaaacaattgaactcatggagatagagagtagaatgatggttaccagaggctgggaaggggagcgaggaaaagataaaatgaggatggttaataaatgcaaaaatagaggtagatagaatgaataagatctggtatttgatagcacaatggggtgactatagtcaacaataatttatcacatattttaaaacaattaaaatagtggaattggaatgttcctaacaaaaagaaaagaggaatgtttaaggtgatggatactctacttaccctgctgtgattattacatatgtatgcctatattaagacatcacatgtaccccataaatatatatacctatgatgtacccctcataattaaacataatttttaatataaaaataacaatgataaacttaaaacataaaaaatctgtctggattttctactgtagaaaatgatttaagaggtgtacctctcactctccagatagatttaaaatctaattatacttgaagttataatgcttaaaactatcttagtatattttgagagaaggtgcataaaacagcacatgaaataagaatgaaaattctaataataacggtgacaaaaagtgtgattgaagttgaatatgcagactcctccagccatgagataaagattaaaatagtatgatgatgcttggattcaatgctaatgaactttctttttttgttgtaggtctcagcattagagaggcagatctttgacttccttggtttccagtgggcgcctattcttggaaattttctacacataatagttgtcatattgggtttgtttgggaccattcagtacagacctcgatacataatggtggtaagtcttatttttatcattttgcttcatataaacaattcaaaatttctataagaatataaataaaatatttctaagtggccccttctgatataatgtggcattgcttttctagccctcaaatgttaaattttgttaagaagtgattatctgtggaaaatacaaaataatgaatgttgtacagtcagatcaaaacaacatgctcaaaagtgtatgatgacatggtgtcactcacaacgtaactgaattcaagttttacaaggaaattcaaaatagtggttggatagagtaggaggtctgcttgtagtcttggtaataggatagttagatgcaatgtacattaaccattaatttatcataactttcagtgacatttgtcactaactccaaaaaacaaatctttctagcataattgtttagtcactgaaaacaataatgtattttaattttaattgatttaggacattacaagtgcatgtatggatggatatttggtacacatccctaacatttcatactgattgatattgaatatttctctgtttgtcaagatgaatttgaaacatatatccaaaacttggtcagcacacactccattataggacagtttaatgaggtgtatgctgtgacccacaatctaatggaagttattcacagtaattagttgtcttttctataacataaaagagttcattactataggctaccatgtgagaaggttgtgagaaataataagcatatatacgtattgtaagttggagtaacatactttaaaatgttcattaagcctgaataaatatacagtgttcagtagaattactagatattttcttgggatacactgatattgcctcactagaagaaaatcatagacttaaaaacatgccatctttccattttgacataatctaattccacctgtggaaaataataaagttataatttttctctgttaatccattctctattttgatttttaaacttggcttttttatttctttcaccatttcacagagatatagataactgaatagactgcattccaatggccttgggagcatttgatagctctcaatttgctgccagggttaaacaatttctgctttactttccttctcttagaaatagcctcaaccaggtacggtggctcacatctgtagtcccagcactttgggaggctgaggcaggaggattgcttgagctcaggagttcaagagcagctagggtttttatatatatatatatatatagaaatccagtgtctacaaaaaaatacaaaaagtagccagacattggggggcctgtggtcccagctacttggggggccaaggcaggaggatcgcttgaacccaggagatcaaagctgcagtaagccatgatcatgccactccactccagcctaggcaacagagagaaaccttgtctcaaaaaaatataaaataaaataaaataaaataaaataaaataaaataaaataaaataaaataaaataaaaatacagtagcctctgctaagtaactacacaatctcctagaagggggtttcatggagttggacttgaggcctaagatgctttcataacatgcataatcaagctattatcaaattctaaatgtgttctagtttgttactatgaatatagagcagttttactcattacagactttttgttttatgatattggtattctgctgcgaaacaaaatacctggtggctttgaaaccatagatggcttccagagaatgaagctataggtaaacaccagtgacatttagtcctggtgattttaccctctaaatgttaaccgtatgcactattcacataactgctgcctttgttgaggcttatgccttctctcttctatagatagactttgcctcttattttctacctttctcccttccaatttgctctttgtacttttcttaaattactggcttaaaaccaccactgggtccttagctggataagatctaagaatattcttgcctgatgtacttgaccaaactcatatctaaccattcttccttttttccttcctttgtcccccaccttcctccctccctccatccatcccttctttccttccttcctccctccctccctccctttctcccacctatcctccctcccttccttctttacttccttccctctttccttttttccttcctccctcccacccatcctcactcccttccttctacccttcctccctcccttccttctttccttccttccctctttccttttttccttcctccctcccacctatcctccctcccttccttctatccttcctccctcccttccttctttccttccttccctctttccttttttccttcctccctcccacccatcctcactcccttctttcctccctcctttcctccctccctctctccctccctccttctgtctttccttccttctttcctttttccttccttcctttcttccttccttccttcttctttcccttcctctccccatcctctttcctttactcacttctttcttttctaactttccttctcccttttttcttctacttattaattcaagagatatttattgagcttctaccctgtgtttggccttgtgttaggtgtggactatactggtgagcaaaaacagacagacacattctctgtcttcctgggtgcttaccttacagtgcaatgaagagaggtgtgcctttatcaaacaattgtccacataaatgttaaattgcaactgcgataagtgatacgaaggagcacactagccatgagatgtctaatggggtatctgcctgtagccgggcaatggggttaggcaccctgcagggagctgagagctgaggtctgctctcagtatgagagtgagtcacgagtatgagacaagtgtgagagtgagtccacaagggaacaagggagtgaaggggggtctgggccggaggcaccacaaggtccatagaagggggactatcagagcagttctgatttactcattaagcatctattgaggacctgtactgtgctaagtttggaaaaataggaaagaattcaaatgtcagaggccctgctctgcaggcactaaccatgtaaggagtgaggaggcgcaggttctggggctctctagaggtgagtaaatggcagtgaagaggaatgagatcatcagtggggcaaggcctaggggaaggcctgagccaggtgtggagacccaggagggctgagagtctgcacacctcagtgtcatgggcctcctgctgcacctgcctcaccagcctcatgctctggtagccttgcctggtgtttgtgtcccggtctagcaatatttcctcagtctctcatggataccttcttccatacacgttaatggtgaatcactctctgctccttcacctctagagtgtcttgagtatgttttataatttgttcatgtttatgtcttctaggcaaagtgttctttgagagcatagaatgtaattagcgctcagtacatacttattgattatttttcctatctagtgtcctactagttcacagagtccacccatgatgaaactgctgtcacttctctgctggtactttttcctttgcttccctctctccctcctccctcctatgcgtagaggaaggcagttttaggtctttcagaatcttcaaagaaaagcatcaacaagaccaacaatccatgtttttgctcatcttgatggtctctttttatggattatgccaaccaagtctctctcattttatttgctatcttattcaggatcctctctcaggaaggggagagaaagaaagcaacaaatttgtgtgaaagctgtccatgcatgtcattaggtttcattctcataaatatcctacagggcatgtattagcttctctgatttcccagatgagaaaagaggtcagaaagattgagcgactagcccaaggaacacaggtggtagtgggcagcagaactgggtgtgtactggcctgtgattgttaggttcaaggagctgctagagcatgatctgtgctttgctttcactggcagattccagatgataatgttaccattgtcagtataagttgtgatataggaaacagtcttggcctacctcccagtcagatattgttacctttatgaagctccagattacgtcttattctaatatgggtataaattatctatttgataaaagtacctaaagaatcattaatctatgagtatgagaaatctgttcacaaaaattgccttttaaaaaagagcatgttgttatttgggaaggttttttttaattcattcttgagttgttgtcacaaatgctttggtttgaagctacaactggtggcctagaattaattctgatatttaaaaaaactgaaaatgaatgtggcatatgtcccattagaggcagcagcttttcaatggcagtgagaagagttctggagcagaaatccatactgacttttcactgtgaggggaaagagctttttcattgcaagagattttctctcaaaattgcttcttctatttttagtattgtcttcctttattggccaaaccaccacacagataggtcaattaaatttaatccatttcaaaataacaaacactttggagcaccaggtatgtgctaagtgctcacgcagagattaataaaatatgtatgttcactgagacaatttaatagacctctagttttacaaaaacacagataatttactgccattttggacaagagacagggttcatcacagctgagtttaagtaattgatcacctttatgaaaatgttttgggtaaaggaccatgagactcaagctcaccagtgactagcttttccaaactcttagagtctaaatcaaagcttatgaaaattgtttctttatctacttctccagcacctcctgcattccccatttgcctaccttgtgccagccacactgaatgatttgtgttttcgaaagaccacatgctgcttttgcctcttcagtttgcacatactgctccttctgcctggaatgccttaatctctctatcctcttggaaaacctttaataatcctcaattaaatagtcaccttttacaggccttgcctgaccactgaatgcaagggaaagtatctcttcccttctgctactgtaaatcctggtaactttctaccccagcaccctacccggctgtcatcattgcttcgctacctgtcttgccccattcaacaatgtgtacttctggaaggcagaactgtgcccatctattgctgtattctaagcctattcctgtgttctaggccaattcctgtatgtacagaccattagatatgcttaatacttgattgggcaaacaataaataaatcaaagtttattggatgaaaggattttacaagatggaatggacagggacttttttaaaatctcagaacatgacagcaatgtactgccttgcttatctcagcctgaacttggttgagggaattaattatatgataaaatagtatgtgctgtgctgcctgcacctaccattagctgacttactcctcaagacttatttttttctaagatgtagtgttgcgagctcctgccactataattgaggaggcctctcggcaaagactattagaaaaaccaccccaaatcacagaatcaaagatcaataattcccttccaggtaccatcacactattaaggtacaatttactatttctgtatttatttttagaatatgaaaacaactttgccacatagtactcctttactcatgaaagtattttggctaaggtgcaaggtggaatgtgtaccttagggcagccattcccaaactttttgacaccaggaactcatttcatggaagacaatttttccagaggttgggcgagttggttttgggatgaaaatgttccacctcagatcatcaggcattagttagattgtcataagtagccgcagcctagatccctcgcatgggtagttcacaatagggcttgtgttcctatgagaatctaatgccacgctgatctgacaggaggcagagcttaggcagtactggtctgtggcctggagattgggaacccctgctttaggggaatactgtgttctgtcttgcgttttgaatgggccttatgtgcttctttggctatagacagtatgaagcagtgaaatcatatttacccttcacaaagcattgttgtagaatcagttatttcctatctgtttactcctcggtcaaatatgttttattctacttctaaatttaaaaataagatttttgtcctataattacttaaatcttcattatttcatgggtgataatttaatcaagcaggttttaactcacatgcagatgaattagcaaatttgtttaacattttttgaaataagattaaccttgaaattaaaattagctcaaaactgcctttaaaaatttgtaaagggtcaagtgaatttgaaaagtccgcaatttagttatctggacttttatgcaaatgctcatgtgcaaaggacaattcattttaatctgaattgttatatagcaaaatttttctgctatgtcagcataaatcccattcttgagtcactgctcaacatgaaattgagtgttaggttttgattcaattggtaaatgtcaaacctaaattcctcttcaccagttattggctgtgaagccttgggatgtttgtttgctttccttttgccatagttacctcatttgaaaaacttgacccatgtatcattttaaataattatataacgtatatgacttgcttactatagcctaacacagagtaaatgtttgacaaatgtttgagatgttcatatgtctttttttcccctttactctactaaaaaatgttacaacaatgactgagcaagaaacttactctacatttttattataagtctagcatattgtatatgatattatagcaaattgatgtgtatatgaaagaatgaatgaatggtctttctcgtaattagaaaataagcaagctcagaaagtaaaaataattcatattataaactaattgcttgatggggaagaaatagactggaagatgtccaaagtttatttccattaaaaaatgctgaaatatccttgtaaaactaggatatatttaggaagccacatagaatgcataaacattcttttttcattattataggtcttgtctatgtggatctggatttaaaatatatatactaaacataagcaaagtagaagagagatggagagattatgcagagtgatttttttcttatattgaaaagctttctttactacaagtatatttaatatacctaaatacatgatgtaagcctgctttataataaccaaagggtatttgtttaaaaatggagagtcttattttttaaattattgcttcagttgaattataaatgaaataacccacttcaaaaagaagatagggaaggtaggcagtctctttggccattggttatcccaatgcttcctgcctagctaaatttctatggccatatttgtatctctagctatctcttttcttttatactcatgatcagatttgtgtctcaagtgcacattaaggtatacttcataccttataacaattcaaaaatcaaaaatatatattttctttgttctcagcaaagaaacacaaatttattagaagaaacttgtaatgtaaatgtactagaagatattacacaatattgctaaaacaaacaacacaagaattccatattatacatgtcacactaattgtaaaatactaaagatactgtcattctaaaataaattgccaattatagaacatatatgaataaaaatttgaggtaaactggtaatttggggaattggtcatttgacaaattgcttaatttggtgactggttatcttgccatgaatctataatccttttactaaaatcttttaaaacaaagcctaccctgtatgtttaagcatcccagctctgaaatcaaactatcaggtgtcaaatcctaactctgacactaaataggtgattaaatgattatccctctacctcggtttcagtgtgatgattgaatgacatgatatatgtaaagcacttaccacaataccaggaacacagaaagcaccaggataataacccttttattgtcaaaaacgtaggaactgacagttgaggtttacatagcctggtaattttgcctttgcaagttcagaagtagcatcaagattacaacttgtgagagatcctgaatatacttcaatcaccaagtttgtgctatgatctttaaatagatgtgttttattatgcatttgttataactatgaattgattcactaaaaaatacctgtgcatttaggaattagtcccaataattaagtcctatcatatggttttgtaattaatttagtttattgccttactttaatattgctttattttatgttcttttcctaatctttttcaatggcttttttctcttgacttagaggttagcattgctctctcatttcaatatacttataattagatttatttagaatggaagatatcaaacactagatgccatcttgctagcaagagcttcaaaacttattgaaagtttaaaatttactaagtccactcttactagaagactttatgaacagaatatattacagcatcagcaatacctgcatataccaaaaatctcactatatatttttacttatcttaactttttaacatgttttccaactaaatttccagtgatttttgagcttttactcattattataattgtattatcttaaaaatgaaagcaaacctcctttcagaaaaacaaatatatgatggaacattaaatgtaaccagttataggactatactactatatgagattattttaaaaattcataaatgacagaatacaaaatataaattgaatttcataaatagttaaaagcttctgataaagtttctattagtaacatacctatattacacagagtctaaattttataattctattgtttggcacagcatagaataagctaaataaatgatttcagtatttattttaatttaaaaacagtatgcaatgattgtaatcactgatagaaaacaataattaaattaataagtctacttaagacattaagaattcattcatttttgtgataaaataaaacgaataggcaaactgttgtatttgatatgttatttgtgttctacagtaagtactatcctcagtcatcctagctggtctgtatgtcacttttctgggcctccattagtttgtctgcataaaaaagtgactggatgagaggagccatagtccaatcattgattctccattgatgagtctctcgatctagggctaccttaattaagaccgactaatactctgggagaaggtatttcctaatacataatatcttaataaaatcaattaatcagtaagaccagtaggtttaaaatttgttggctggatatgattggaagatatgaaaatctgttattcatttcctcattcttaatcctatttattaatttctctgctttaaaatattttatatggttatatttttattatatgatcatattagaggcacacattctactaataaaatagtccaacaaacgaaagtttgttaattttgtactccacgcatgttttcttcaaacatggtcttctttcagtcctaggtttccataaatattccttaaaatgtgacagttttatactgtaacttaaagatgatagagagctcacagaagatttgcatagttgtgttccctagaaaagataatactcagaaaacagaaatcaaatcaacactttggtttaacttgtacctggaagccagcaaagcactttaaaagtaaatctaactttgttggtgtctactgaaagcagtagaaattattgaatttttaatttctggaaagcttaggggaccacatagagagcactcttttctgagcgctccgtcagtttcttcccagaagacagacttattgacatttttattattgatttatttgatatacatgcctttcatctccatatttttcttctctttctccctcccccatttctatctagtatacagtgtggactgccctctgggtcacctggaatgtgttcattatctgcttttatttggaagtaggtggactctcaaaggtgagtttatcatgcttttaaagtacactttaaaatgagtacacttctaagtattgtgactacatacatatataggtatattgtgtgtgtgtgtgtgtgtgtgtgtgtgtgtgtgtgtgtgtatagaatgataaaatactattcaaagaagactttaggtaccacttaggaaagaatgatcttaggagtgtgttaatatcatggaacttcaaaacaactgccttctggtttagtttgttatactgaagtgggactgaacttacagtgtatcctcatgtccattttaaaaagacataataccatagtgactgcaggcctaaatattaagtagaaaatggttttgaacatgcttgtgtttaaagtaggaaaagggattgatgaagatgttaacgtaacagacatgaatggcaagtttctatctttgctggaatattaattctggaaaaaattgaccaagaacaaaactcttatattaaatgtttactaagaagtaaatgcatcagcgtggtgattcctattttgaaattttaatcacacagaagacagttgtcttaatgcagcaatgatacacacgttatttctgcctgtctagaactgtcagcaaagcacatgattttattatgcctcctgcaaaaatgtctcaccacccaaatgtaagaacaacttaagtttctagttgtgtttcttaaacagtttttgtgtgaaccagcacaattttcactatagagaagaaacttaacagtattacaaaaagtataagaaagctgtcatattttaaaacttctcattatcaaatatatttatactaacttattctactgctttataacagtctcagattttctaagtaatgcacctgtggcttagattttagaaaatgtgtcttgagcagcaaggatactttaagaattcttaggttccattgaagtccttgtggtaacaaaacatgtttgattcagccaagcagcaaaaatccctgaaggatttttccagagcctccagaggtggttactcttttttctccactataataactgtaattagaacttgtcaccatttgctcacattggcaactgtattcaggaaccagaagcaacgtttccaatattgagttcagtatatttggactaacatctcacttaaataattgtgctagcgattgtagttcaccactaatttctaagatataaaaaagtaattaaattaatgtctagttatattctataaattcagattatgaagtaattttcaaatgcaaatcttatgaataaaataattgcaaataatatattaagcacaacattttcaactcactgcattttgtatcttgcgatttggatggtcattttaatcatattttttatttcactgggtagaaattattttttcttctatatacactaatttgggataaattagaccagagaaatttgtcctatggaattggcttcatagtattttgaaagaaggctgaattttgaatcataagtcttgagtccaaatctggtcttcagcacttattaactgtgaactctgaggcaaatcctttggctccatggagtctctatgaaaaataataagaccagattttccaataataatagtagtcagtgtttattatacacatgatatgtggtaactcaggtaagctttgaaacaaatctatgaagtaataaaacaaataaataagtatcagcagtcatttttttcatataactctgatttcccactgctattcaaggttatttttgtgaatttttgtaactgcttttctaatatccatgtgcatgtctaaaagtttttatctcatttctttggggacaaggttgaaaacatggacatagtagtcctggttactcattttattacctatttaaatgccattaagcagtcaaccaagtattctaggtcattaaaaagatagatgactccaaaaggagcatcctaaagattttctgttggtctcctatttactgcctcaaagactggtaacatctcccttgttagtcacagtttagcctcaattccagtctatgggaaatctattttggaaaataaagcaaagttaaggacccttgacaaacacaaataccagccacttttccaggttcgttccattgtgtaggaaactcctcgtccatatgagttggtttatatactaactttctagattctccatctcctgctagttcatgaagatacttcttggaattatccatttggatagattaatagaaacctccctatgctgtcaatttggtccaaaatatacattctgggatagtgaatctttctttaaaaatggggtccagagtgatttccacaacctctctgtggattggggtgttattccaatgacagacatggcctatgaatagcacatttgtacgctaaggtgttcttttgctgacaatttgcattcatggagtgacagcaatcctgtcttacctgaaagatagtgagctgtctcatgggcaggaaagcctggaaactgagattcttacaatgctgggcaggctgacagtgctgcatactcttgtgttttaaaaagatcattttaatttctagtaaggtaaatactgatagatgtaatccacataagcaaaagctgtttaggatcctcattaacatttaagactatagaaagaaactgaggacaaaaagcttgagaaccactcccatagagtaaccaatataactaaataactaattaactaactaaataaaaataatgcaaacagtaagaaaccaaagcagatgttacaaataaaaaacaaataacgatatggtagattaaaacacaaccatgtcaatgactatatgaaatgtaaatagaccaagcactccagttaaagacagagattagaacaatggatttttaaaatgacaatagttaatgttatttatatgaaatacacattaaacataaatacatacatatatttaaattaaaaagatggaaaatatatgctatgtaaacgataatcagaagaaaacctctgtggtcatattaatgtcagaaaaaaagtagacttcaaataaagagtatgaatagagataaacagatgttttacaatgataacaggatcaatgtattaaatagacaaaataattcaaaactacaccaaataactgaattttagaatacatgaggtaaaaactggcaatattaaagggggaaattgacaaatccattaacatagggggagagtttaatactcctttcttgcttatttagagaaaaagtagacacaattcagtacaaaataaaatatttgaacaacacaaagtcaaacaatgtgtctgtcatatagaggatattaccttaaaattacaatttatattttctattcatgtgcatatgaacaatgaccaagatggcattctgggccataagcaagtctcagtaaatgttgaatgactgaaataatacagataatattctcccaccacaaatacaagagtaatttataattgttaataattcacaaatcaaagaagaaatttagaggaaaattgaaaaataaaagtacaaaattaaagtacataattaaaaaaaaatcttctttgtggatgaattcctatcagtgtttagaggaagaaatgtagatttaagttgcttattagaaaaaaagaaaagttaaaaatcagtgatatacacttccatcttaagaagagcaatttgactaatatctcatagttggttctttgaaaagattaataaactaacaagcatgtagtaaggttgatccaaaaaaagaagaaacaatacaaattatcaattcattaaagaaagaagtgacataactacagattcaacagaaattaaaagattaatagaaaaaaattaaacaatcaaaaatattgatagccatgaatttataattaaaaatctttctacaaaaaaatcaaaacagaaacaaccggtatgcaattggttaaggaaacagaattttctgtttaaaaattttggggttagtagaaaaatgtcaccttgctagagggagtaactttctgcaagcctctcaggtaaaaacttagaacaaaaggcaatagttaaagtttagtcttcacttcccccaaatctgggctctgtgtactagcagatctgttaggtggggatcctcagtgggggtctgttcagatgttgtctttaatttctatagggaaagcaaacatccctggagctttaactcccttggctattgttaagactactattaccttcttgtttagcaagttacttaattacctctggggctagccagatgcctggaatttctctttaaaaaaactttggggtttttctttatttccctgcttggagttttgcaggacttcaaaaaaaaggtcagggtggaggtccttgctcaggatcaatctatcaaacataagaaatacataatgctaatcttactcaaactcctacagaaaatagaggaggagggaccatttcacaaataatttggtgagctaacataatcctgataccaccttatagacaagaattaaattgacatctatgttttagcagtccttggccatctctccaggaaattcctcattagccattctgccaagagggactccacacggtgaattgtttgtcaccacctgatcttcccttctcttcactcccaggctctttgctaagatcaaaattcttgctcctttatagatcaaatcaaatcagctctacctttttgtttccctcactaatccaagctatttccagacatcctcactttccttatctacaaaggcccaaccaaatgttttccttaaaaatgagctctctgtcctgcagatgagaaatgtcactctgtcacatggcagaagcatctatagtcagattgtatttaaagacttttttaattccccattacatttcactacattttgaagtggtagttgttatcaatcttaatagtttgttctactggaaatagacaatgactttagattttgttttctttctttcttttccttccttccttccttcctcccttcctttcttccctcccttccttccttcattcctttcctttcctttcctttcccttcttcttttttgtcaacagggtaagggttctttttggttagagttcttttctcataataaaaaatatatattacatatataagttgcagaaactagaaagacaagaagaaacaccatttttgcttcaaacatttgaagaccactgccgtgaatattttgattccagtttattctcattctgctgtgtttccatggtttttctctcctgtttttcttattattgttgagataatactatagagaaaattgacatactgactttttaaaaattggacttaatgaaaaacatttttatgttgttactaaagtcatggttaatatttttaaattttgtgtaatattacatcaatcatgaatagttattttttctgctctttctttaacaggagatgttaaacgcttctgatacattttgctgaatttcttctccaaaaagcataccattagctgtaaaatatgagtatctagagtgtcattagcacaagttaatctgtttcaccatttggggttttttggggctattttctttttttttttttttttttgcagttgcaagatttaatagagtgaaatagagtgaaaacagagctcccatacaaagggaggggacccaaagggggttgccattgccagctccaatacctgggtttatatcccgatccttgtccctcccactgtgctctcaggcaatagatgattggctatttctttacctcctgtttttgcctaattagcattttagtgagctctctgattggtcgggtgtgagctaagttgcaagccccgtttttaaaggtggatgtggtcaccttcccagctaggcttagggattcttagttggcctaggaaattgttggggacgttggccgacaacaactctaactgcttcctgttgaattggggtgtagtaggggttgtgcagttgagatttcctcgggaggggtgccttcgatgtcattaacatcggagcatgggctagcaggcctgtccaggggtctatggtagctcttagtcatggactgcatctggagctccatttgaagaacgatttgtagttttacagctttgactctgaaagagacaaacttaacaaggaggttaaagatacaaggattgaaatgtatggcctgcagtgcaggggattacttgtttggcacactttacaggccctgactatatgcttgatagttttgaaaaggcctgatccagtaaataataatttggccatctgatgggtactatcaatgcctaagtgaaaggtttggtgaagggttttaagtaatttccattggttagctgcaggcaaaagtattttttcttcttcggtggctagccatcctgaggggaggaaactatgtcttcgtgagtttcctcattctatttcttcttctgagtactggggctttgtttcctggaggtgattactccatactaggggtccttctataagcatttctaatggagggtcctgccttgcagctcttttggcttcaatatccactgggcagttcctttctatttccctttcctttcctttctggtgaccctggcagtgtaagactgccacctttttaggtttctgtacagccaatagtaatctcctaatggcttcctgatgtttgacaggtgttccctcggaagttaggaattccctttctctccatattgctgcatgggcatggaggacgatgtaagcatacttagagtctgtatatatatttacccttttctctacccctaattctagtgcccaagtgagggctattagttctgccagctgagcactagttcctagagtgaggggattactttcaagtattccgttatcaccgaccactgcataccccacttttcaaagtcctttttctacaaaggaacttccatcagtatacaagttgaggtctggatcagtcaagggaacctctaaaaggtcccctcgaacagcataggtttgagcaattacttgttgacagttatgttctatcttttcttcattgtctgcaagaaatgtgactgggttaagagttgcacaagtgcacagttacagcactggcccttcaagtaatggagcctgatatttaagtaaatggttgtctgacagccacaagtcttctttagcagtgagtatgccgttcacatcatgagatgtccacacagtaagatctcttccctgtattattttaactgcttctgatactaagactgctactgctgccactacccataaacaatgagaacaaccctttgccactacatcagtttccttactcaggtatgccacgggttgcaagctggtccctcggacctgtgaaaggactcctagagctattcctgtttcttctgtgacatataaagaaaagtcttgccccgttggcaagcttaccactggggcttgggttagggccttctttagggcctggaaagccgcttctgcttcatgtgtccatcttactaaatgggtatcggctttctgagtttccttaattagtgtgtataatagcctggctatttcgcttttcatggtgaaaagaaaattcttatttctttgtttaaagaataatttttttatttcttcaaagttgaatatctcctaatgtgtttgatagtcggcttttattttcactttttgttaatagggtttgtctttttgtgttttagtgatgatgtttttaggctttagtctctatggaacataattttgttctatttttcaaggtgaaaatctgaataggtattttttaccaataactgaccaatggcaaaaacaaaatttacttagtaggcttttcactggttttgcttttttatgatataatacatttctataagatctatttctagaatatcatcattttcggcacatactactttatattagtttgtatatactttataataggaattatctctctgcaatccagtcttcccaagtctatgacttaacctcatacatttggtttacagatgattttagaataaatctgttcaaatatatataatgtatattatatatctcattttagttttgtttttgttcattatgtttaacttttaatttaggaaagattgagaaaaatttatgttagagaattcaggaggaaagttttgagtaacagaatcaatcacagaggatgtgaactaaaagttccaacgtcaaactccttatgaactagtcatcacggattgtgttaatattcttgggtatcacttgacaaaaattattttttcagtttccttactccttagtttagcaaggtacaagttcttgatccatgaccaagaagtataaggcatgcagacaccggagagtgagtaaggcagagtaggattcattaagcaacagaaaagctctcaacagcaagaggggaaccgaaagtggattgccagaaatggggctgagtttgggtcttttatgtggcagaaacaaggtagtcttctgtgtgttctgccttaatgagagaagtaaagctgccccctgtgggtgttgcatctgtgtatgcctaaggttggccagagtgactccatgttgattattactcatgagtgcctaagcgaaacccatagagggagggtggggacataactccaatgttaatgatattacaattggctctgggtcaagttaaggacatttagtggatttattttgccttcacctaagttgggacagtcccttctgagcagacatcctggtataagaggaagttcttaaccacgtttccaccctgctacataggggcagtgcagatgcattcccgcgggttctgtctctctccttagaccctccctctgtgtctgcctagccagcctctaactgtctcctctctctaattcatgtcccttctaattcacgtagaagggacactgtgttggagggacaacagaggtcagagaagtaggaggcaggaggactgggtttggaacagctaggagcttaggtagacactggaggctcagaggaatgactgtcttgtcagaaaggcacagctgagatgcaaacaggatccagctgttgtccacctgctcactatttaaattactagggtgtgatggagggtgtaatgatcccagctggatcaacatctgcctctttgccacaggaagacagggttcaagattagaggtctcactgattccataagctgggaaaaaactaatttcaatacaaaacaaaatggggtagtctcaagaaaagagagacaaccatggccaccacagagcatgtcttaatcattcttatcaactagtaatgtatattctcatgggcataaacaattatgcctcttgcatattatgggagtcttgatcacagcctccagatattccctttccttttgtctcatctgccagcctgccctgcagcaggcatttgttaccgcaggcttgagtgttttagttctccccatgcctttcagcacttgaaggtaatggatgccttgttttaaggaatgtgtatatgtatggtggggtggggaatgactgtgggtaggtaactaaaagtgtctgtctatacttgggtaatctcctgaagcctcaatttcctgttctgcaaaatgaagaaagccacaacaataatcgcactgggttgtggaaagaattaaataatacctatgcagggcttagaaatgatcttggcatattgtgaggtttcagtaaatggtggttctcattattaccttcaacatcatcatctttattattattggagaaattaacagacatcacaatcctcatcctgaaaacctttgggatgtatttattactatgcaagagctgtaaaagggaagaattgtaggactgagtgactcgtttaaaaatatgaaagagtcccttgtgataggacctcagatctgcattttaacttcacagctgtaacagtattaattaaatcatttccttcaacatgtaaatagctttttgacatacatctgcagccagattctcctggtgtccctaccacttcccctaggagtactttaagcatctttggaagtctccaaggctgtttttcttgccacactttaagatcatcaagggcacaattaataagttattgctgcttgtttggaagttacaagacttgaaataattttttcctcctgaggaatacatttggaattaaatatgaaaacccatcttatttgctacacttaaagataaagaacccaagttttaatacttttattccaaagaaattagtccaatctgtcttaatggcatcttttaattattttacatttaaaataatttaaaaatttctaggtacattttacctagaaaatttaggttaatatttctcctaattgacttatcttgaaaggtttggtacttacatattagtagtcttagagaattttcaatgtgtcacattttcatagaattctgaacctgtacaactgtgcataagcataactttgacataaaaatgaatgaaagacattctacaaggacttattttatattaatcatgagctttgatcaggggccttctaaaatcttataggcaggggacaggggaggaaaatggactaactcttactggtttcctacacagcacaggggcttcccatcagtttttttccattttaaccctacctcagaggtagacattagtatctttattttataaatgaggaacctcatccaggagaggctaacttgctcaaggcacatagcagtaaactgagatgtcaggtcttaatgcttccttccgaaggtcacttcatttcccattatagcaagttgcttcctacacagaaggaaaacccacctgcatttgtttctctatgacatgttttaacagctatgctttttctaacttgtgggcattttgattcttggagaaatttaagccatttcctcagaaggcaataatagcaccttattgtcctcttttgacttaaattttttgacttaaattgacaccatcattcatgagggtcctctttttaaatctttagttgaatagttcacctgagcagccaggcagcatcagtgaaatagttcttcctcttcaaggctcattcttattacttaccttgaattgttcctttgcacttactgggaaaattttttgtcttgatcaagattcattttccttcaaggttggattcttctatcaactttagcttttgggcaggcaatttccagtaaaatattttagaccgtcaattcagagttcagtacatgaacaattgcagaggaaacagaactctcagtttccctcagctgcttacaatctatccattgtcttttataaacattcaaatatttttgcatctcatagagttctttttctgatggtagtttgaaattaaatcaaggatatatagcatctttccttttttatttaaacaaatacaacctactgaatctagtaaagtttttaagtcatatttatattttctttttgatatcttcctacctggacatttttcaaaatgaatcctaaaatgtgatgtttaaagaggaatggaggtagggtacagaatatctatattcagaaatagtatatctggcaaattgtacagaaatagcatcctagaatcacagccaaactatgcccacttctggaactacaagaataatatcctatgcactattctgtatcctgaagtaaatggatctatctatatcaatggacactttgggaaagatacatattcatttcactagaataacaaaatatttcaggttctgaactaacatattagtaggtatgtatcctgctgagctaaaggaatatttttgtctataatattgactgatggtggtggtagtggctgtgagtatctgcccacttattaaggatctgtaaagggagaatcatcacaatctgcttccaggtactaaatctaaatgagaacaaaagcctgaaaatgtttattgttatgtttggttcctgcacaatctttatccaaagagacgcaattatattcttttaaaaaatagcaaggaaatgtaaatataggtgtgagtttcctattccaaaaatttaagctacgtcttttcctttggcatgagtctaagtgaacataacttctaaaaatacagtcctcagtttcttttttatagtgagataatttgattcctcctgtagcttttctacaataaagaaaatcacaagcaaggttaagctcagtcttatatttttcataaatttcatcaaatacaaatacctcaaaaatctttatcctaaaaagccaatttgaagctacattataagccaacgacatatataaaacacaatctaaactaccaagtaattgccacaacctgggtagtattaagagtttttaatcagaaatttgtattgtaatcttatgcctttccataagggttcaaatcgtttttaccaaggagtagatgaatatattattctatcaacagtagctgtatttcttattatatgattagaatcacttattgaacaaagcctatgcaaatataattgaaacactatccagaaatatgttgtctttgctctttgtattttatcttttcttcttctaatgaaaacacacctgagatcaatatttaaagataaacattttacctttgtatctagtttattgactcaactcatgggataataatcatgaaatggttttatttctttgaataaactgcttccccaatcttctgccccaaaccctctttctgtttcataaaacattgtatacagagtctatgacaacattggtcataaaaagcttgtttcatgtctgattcacatctattctttccccttaccaaagctgaccttgttttaggccttgacctctccctgatcccaactctactctgggacaagaaacaggaggtagtgggtcttcttacataaccagtcttaagattatgctggagggtttgaaggatcctgatctcataatgatgttggtctgttccagctactgctagtggcctctgctgatgaatctccaaacatggcaaattcttccactaacttcaataagtcaatatttatttttaatgagtctataattattctaatacatgaaaatttgttaacatttcagaacattacatagcattaagccattctgagtagactccaactgctgagctgaattttcacgtaagcatcattatcaagagaattttggtgctgtgaagaaaccacacttttatagcttatattcaaatgcttttctgtgtttttgaagacaatttaaaactactgctgcagaatttttcatgcagtcgattgaagataagatcattgtagaagaacaatacgtagaaccattattcttataagtgacattaagatttggattttcttgtgatgttgatttgcttcgaatgcaaaatcttagtgttgtgacatgtcaattaagagtacagtcttgatgatgaagaatttctggtgacatttgcaacaattaacaaattataaaagagaccctgataaacacgttttgtgacatttatttagtttttaaaaccagaatagcagtgtgtactactggatagccttataaaataaaactgcaccacatggtgagattatgattgatgagtattaagctgaagtgccctgcaggagcagaggagcctcagataacaattactcaatgctactcccacgtatgttacagaggcaaaacttaagtcatttaaattcttcggataaaatttttccatgtagacagttgaaggaaaaaaaacacagataatattaatcatttctaaacagttatttttgcacagagaaagtttgtctctgagccccatgctataatggcatgaggaattataggctgaggcttcagattgaacttaattagtgtcttgcacacatatggccctggaagcatctgtgcatctgatttgtgcttcctctggttgtggttgtcactgcaactttgatattgtaccagctaccttagcataggagtcaggatccctgactcaggaaggataagtttgagaatgcaaggtagagagaattctgagaagattaaatcaaatatatgaagaaatatgtgaaaaatgattggtcagattagtgtcaaagctgagagaggtggaaagagagaaaggttttgttttatctgcaggaagccactaacagaatgacagtttctgcagaaacccttgtaacaagataccctttggtatgaagttcctaacaagccagtgtctgccgcacagcagggctgcctggaatgtctgctgcggcacagaactgcccaaggaagagagtcaggaaacaggagagattccatccttccatgtcccatctgaggactaatagaaaatagtgagaaagttactagagtgaagattgtccagaagatgaggcagaactggctggtcccagtagaggccactgaatggaggcaacaaggtgacagaattaaaaaagaggaagaatccgagtgtctgataacaagaatgagctagaatcgcctttgccctttggaagccctcagcattgattcacttttgcctgctttctgattcaggaataacagtaggacaggaaaaatacagtacacagctgtgtgtgtagtaattgtcggtgtgcttgcatgttaaaatcagtatattgaaacatccagctgtctatgctcacttaaaggctagtttttgtctgaaactttcatcccactacagaaaccagatggaatatctcacaatcaaataacagatgaagctgaaaaacaataaaagcatgtaacacataattctactttattcttgtaggagccactttaactcaaggctctgagaacttatttatggaacccaaatattagtaactcgtaattttctaaaagaatagaaatttaaaagcatacatttctaggattagaattggatggggaaggacaaaagttaattgaaatttagcaaacttcaaagaaaaagaaagaatatccatttgttaaattaatttacaaatgggaagtatagctttctgtaaaaatcatatcattttccaaattttctaagtgttcaactatattcatcaaatcattctttcattaaacaaatgatggcagaagtttctggttatcgtccataatctattcccgcttcttctggtcaagagtctaggaaaatcctgctctcgtcacaggtggcagggctaaaaagctctatttctttgtctctgtaggtgtaggtatggtcatctaagtaagttctggccattgtgatacatgcagaaggattgtgaggaacttctggaagggctgctgtagagctaatgaattagaagctgacccaaacttagtgacttaaagaatacaaatatgttcttgcatttcttctgtgggtcagaagtctcatgtaggtcttaatgacacctcaaaatcgaggtgtaagaaggggctgtattcctttttggaggttctaatgtgaccttgaggatgtcaaccatgcattagaatggtagagctgaaaacaaaatgagcctaataactcaacggagctttcagaccagccctgagctgcccatgaccggatttgttttacattagaaaatgtgttcaagccattgtctgagggtctgaaatatgcaactgaaaaccgtgcctatatcattctatagtctattttatctagtatttactcggttcaaagcactataccaggaactagggctacattcagttgttgcccccataaagtatttagtatacagtctgccctctgaatctacaggttccacatccatgcattcaaccaactgcagatcaaaactatttggaagaaagcaataaaaagtaacaatacagaaataaaaaataataccaaatttaaaatgtagcgtatctatttacatagtatttacactatattaagtattacaagtattctagagattacaaagtatatggagggtgtgcacaggtcatgtgcaaatactatattattttatttcagggatttgagcaccctcagattttggtgtctgcagggggcctggaatcaatgccccgtggatactgaggaacaattgtaatagaaacaaattttctattaaatgagtattcacaataaaatgtagtgagaattatgataatggaaggaaaacaaactttggtattttaaagcagggaacacagttttcctaaggaagagggaattaagagcaaagaacattatagcaaataacatgctgatcttcacagatatgctgtaattgacctaccttcagtgagaaaagtgcttttcgttgccactcttaaaaattccttataataaatgtgcgtcgatccaccatctccatcttaccctcttttctcagattgtcctttggcaagcacatattaaagagagaacctccaaggattacatggatcaggactaaggtcactacccttgagaggtgatcctgtagggtcatgctctaaacaagggaggtatcgagttacagattgtaacaatcagtggcctgaaaatatctgttcaggcacagttcgggaaaaaatgctagtctactagtgttccttttgaggttatctgtaattttcctaagcataaatagacaaatgtgctcctcaactctaagaccatttcagtgcacaactgcactatttagcttagagtcaatactgattcaaaaagtatttcaaggaagggtaaatacacttcctgcaaaatccccttaagaaagtatgctgctggaaaaaaaatggcataaagaagtcctttcagaacaagcactatatccccacacttattttagccacagaaattcaatttggttgagttgtctggggacttgatttgaccctgtttccagaacaatgtgcaatggcttgacagaatcatttttaaatgggccatctgatgtttcagtttgtagatataattcatcatttatttttgtcctgtaattatagaattaatgaagaaaacacttcctctgtgtatttgaaatattaagggcatcaagtcattttaagtattagtttgagaagatactctgtcctgcttcaaggcagcataggacatcagaagcagtgattgtgtagtgagctgtgctcatcattagctgagatactgagacagtgggtgtagttatttcctacatacaattaatgctgcatgccaagagcattatattaattttggttcagtataaaatgcaggcaggctactgatccctgaaatcaatgactgtcagaagagcctagacattgggcattgggtgatcacatgaataattgaagactgatttgttaaccatgtagaaatgaagttagccatacagggagacaccttatcaattgccagcaatttgctgtcttttttgaaaaccacaggcaacaatttacagaaaagattaggccagttattgtacacatgtgacatattcttgatttaaaatgtcaatctggaaagctgtaaactgacacctggattttggaatgaggttataaagtttatgaagaactgattttcccagagaccgtctatatttctgctgtggaagatccctgaatgcacaccccctgctggggccaactatgtgtgtacaaatgggcactgtcatggaaggctgatgcaccttctcttgggaccattcagcacctttgcatcactcagtgcttgaatgcacttggtgttcatgacagtatggtgatgagcttttatttcttggagaaaaaaatgttgtctatatatttcttcttcctgtgcaatcctgagggttataatcactttcatcctgcaccaggaatttacatttcagtacttcataagaaaatgattaaagggaaatccactttttattagtgtaatttctttccacttctttttcctattggtattaagtcagtaacaatcattttttttcacatttgaatttgtgaaaaggtgaaatgaaggtagccttggcccccagagaaatttgaaaccaatatagtatcctgaaggatgactgctattgaaagaatatttataaaatactgtgtctcatatttaaacaccatgaagtataacctatgagtgatcattttctgaatgttaccaaaaataggctttttgtatacgttgaaatgtattctcaatatttacattaatttattaacttttccaaggattcctagcaagcataatcttgcaaatctaattttgttattcctaatctgaaatcacatatgccaatgtaactatttaaaaaaattgtgttaaacttttaatatgagaaacaaatcaagactccttatgtgtgtcattgttagcaataaaataaatctaaaaactaagacatatactttctttcttcttcttttcaccctttctatatttgcccacctggctgagtctataagctcctttataaagtgatggcaattcttgtattttgctttaatcattctttcccacacttttctttttcctaaaaggagaaaaacattgataaattggttttggtttcctgtgtcacgtattaaaggtgaaacctgaagatgctaaaaattgatcataaaagccaaaatttgaactgtttaataatagagattagtattagaccatagctctggttttgcccaaatgtttgtggggctttctcaattaaagaaatcaataaaataaaaatgtacatgaatggactaattttaaaactttatgttgaaaactggcacagctctgaagtggctcagcaggcttccctcgcttggccgtctatggcaaacgatactcttgccactcttggcaaacatgcattattttacatgagagtttgggaagcatagatttggaatggaaatggaaatcacattcaacttttccaagatactctcttttatgcaacaagcaagcatctgcaattatagcatgtaaactttaacttccttaaactttcttatagaagtcacaaatatttttataattattacagaaagaaagttttaaattatttatacagtcttggctttggggggatctaatcaatgaaatcatatagttttattgtccattcattgtctatagcatttttaatataaattaagatacactttcatagggggaaaaatgtccaatgatttagaaatagctatgctatggacaataaaatcatggttttctgtgtttgagtgtttgactaaatgttagactagaatataataattgtggcagcataacagaatgttttcaacttagtaagctttgacttttgttgcaaacatcaggaaattaatctctaagtctaaactgtgataggtttacacctgagcagcctcttgctgctcaggtcaggctataatgatttcgacttgatctatttctttacctttagaaactccctactttatttttcactaaatcatcaaaaaccttgtgccctttgttacaccaaacatagagttgttttattattagtttgcatttatattgtattttccctcaagtagcttgaggtgctttacagaacatgacagcagtcatcaaaacactttgtcaggtaagtaaagtgagaaataatgctgttataaatgtgctgaaggcattgtacttgctggaaaatgtttattttctacatattttgttagatacaatcttttcagtgattttgtttaaaatgagttccaactcattaacattttcttttcttggctttagaatcagacacatttgttcaacaagtttattgggcatctgctctttgccaagtattcttgtagggactgagaatataactgggggataaaaagaatttgctctcaaagagcttttattctggggaaagagacataatatataaataaataaatatacactataattgcttgttgtattaagtgctatcaagagaaaaaaacaacaaaataaaaggaaataaaaggatagagagtaacttcatgagaatggaaggagttgagaggccttggtggcagaagagagcacaaatatgggggaatgccaagtctcccagataggaacatgtttggcatgcacaaagaactgaaaggatgccgagtcatgttgctagcacgccatgagccagtagaggagagccgaagaaagagcaatggcaagatcctacaggaacgtcgtgtaggtcataacatgatttggatttggtctcagtataatggaaacccattggatgcgactgagcataggggactgacgggatcagaaattactgtgtaggggacaagagtgaaagtaagatgacccacagagatcatggtggtccaggtaagaaacaaaggtggtggccaggtgcagtggctcatgcctataatcccagcactttgggaggccgaggcaggtggatcacctgaggtcaggagttcgagaccagcctgaccaacacagcaaaaccccatctctactaaaaatataagattatccgggcatggtggcacatgcctgtaatcccagctacttgggaggctgaggcaggagaatcatttaaacctgggaggcagaagttgcagtgagccaagatcataccattgcaccccagcctgggcaataagagcaaaactccgtctcagaaaaaaaaaaaaaaagtgcttggatgagggggtgacagtggctgaagtgagaataatgagtttgaataatcagttcaaatatccaatttcaaagcagagtagatagtagatagtagtagaggtggtgcatgagacagaggtgtgtcacagacagaatctttaattctgtctctgacacatgtgctattgtctcagaaactcaaagttttcttaccagtaaaaatgcaaaaataattacatcagagaaaactgatgaacagctgagaaaactgagaccttgtgcagagtatacttttgatgctttaaaaatgcatcctgtctcccacttctcaactagcctttttctttcttactttctattccctataacgtcacactgcttatttctcttttccttgtgtttcctactttgttgcatcatatattgtccttgccctccaaatgtcttatttccagatgccaagattctgttcattgttctctttgaatacagaaggggttggttgaaatgagccctactacgttttttactatgttcttatgtacatatagtttcatagtagaatcttagtttcatagtagaatagtgattctactgtgctcttttttggtttccataaaactcttggcataatagttgatgtacttctaatagatacatctgaaatttcagtgggggaaaaaagctaaatatgaaatacttgcttccactatcagccagacagtctttagcactgagaattaaaaagaaaatatttttgaaatttagagtcaattctacccagttatatatgttcaccttgaaattcttctaatttcttttttaaaaaaatgttatgggtatatagtagctgtatatatttatggggcacattagattatttgatacaggcatgaaatatgaaataagcacaacatggaaaatgaggtatctatctccttaagcatttatgctttgagttaaaaaaatccaattacattctttatttaacagttaaattattgactagagtcaccctattgtgctatcaagtactaaggtcttagtcattcttttaaactattgtttgtactcattaaccatccccacttccccccatcagactcccgctctggaaatcatccttctactttctatgtccatatattcaattgttttgatttttagattccatacagtgataacatgcaatgtttgtctttctgtgcctggcttatttcccttaacatgatgacctccagttctacccatgttgttgcaaataactggatctcattcttttttatggctgaatagtactccattgtgtatacgtaccacgttttaaaatctgttcatctgttgatggacacttaggttgcttcaaatcttcccacttttaaacagtggggcaacaaacataggagtgcagatatctctttgatatactcattttctttcttttgggtaaatacctaaaagtgagactgctggatcatatggtagctcaatttttagttttttgaggaacctttaaattgttctccataatggttgtactaatttacattcccaccaacagcatatgaggtttcccttttcttcacatccttgccagcatttgttattgcgtgtcttttggaaataagacattttacctgtggtgagatgatatctcattttagttttgattttcatttctctgatgatcaatgatgctaaacacctttttcataagcctgtttgccatttgtatgtcttatttgagtaatgtctattcaaatattttgcctattttttgatcagattattagattattattataaatctgtttgaattccttatatattctggtgattaatcccatcagatggatagtttgcaaatgttttctccagctttttatactgggacctatctctctctttagctctaataatatttcctttctatatctgggtgctctcacattgggtgcgtatatatttaaaattgttatatcctcttactgaaatgatccctttgtcgttacatagataccctctttgtcactccctatagtttttgtcttgaaatatattttgtctgatataagtataatgactcctgttcttttttggtttccattggcatggaatatctattttcagtctttgtgtgtctttataggtgatgtgtgtttcttgtaggcaacagatcaatgggtcttgtttttttttttaatccagtaagtcagtccatgtcttttgattaaagagtttagcccatttacattcaatgttattattgataagtaaggacttactcttgccaatttgttatttgctttttggttgttttgcggtctcttcttccttctttcttttcttcttgtcttcctctagtgaaggtaattttctctggtgacatgatttaattattttcgttttagtttttgtgtatccattgtatgttttttggtttgaggttgccatgaggcttgcaaatattgtcttataatccattattttcacgtgataacaacttaatactatttgcataaacaagcaagcaaaaagaaagctaataaaagttctataccttaccttcctatccttgctttttaactttttattatttctatttatattttattgtaattgctatgtcttgaaaagttgttgtggttattatttttgattggttcactattttgtctttctacttagaataagagtagtttacacaccacagttacagtgttatagtattctgtgtttttctgtgtacttattattaccagtgagttttgttccttcaggtgattatttattgctcattaatgttcttttctttctgattgaagtactttctttagcctttcttgtaggacaggcctggtatttatgaaatcactcagtttttgtttgtctgagaaaatatttatttttccttcatgtttgaaggatgtttgcactggatatactattctaggacaaaagttattttccttcagggctttaaatatgtcctgccactctctactagcctgtaaggttttcactgaaaagtctgctgccagacgtattggagctcctttgtatgttattcttttcttttctcttgctgcttttataatcctttctttatccttgatctttgggagtttgattattaattgccttaaagtagtcttctctggataaatctgcttggtattctgtaaccttgtacttggatattggtatctttctctatgtttgggactttctctgttattatccttttgagtaaactttctactcatgtctctttctctacttgctctttaaggccagtgacttagattttcccttttgaggccattttctagattgtttaggcatgttttattgttttttattcctttttctcttctgattgtatatgttcaattaggctgtcttcaagctcactaattattacttctgcttgatcaattctaatattaaaggaatctgatgcattctttgatataccaattgcatttttcatctccagaatttctgctttattctttttaattatttcaatcactttgttaaatttattgatagaattctgaattctttttatgcattatcttgaatttctttgagtttcctcaacacagatattttaaattctctgtctgaaaggtcatacatctctatttcttcaggattggtccctggtgcattatttagttcatttggtgaggttatatttttctggatggtgttgatgctagtagatgttcttcagtatctggccattgaggagttaggtatttatcatagtcttcattgtctgggcttatttgtagccattcttcttggggaggctttctagatatttgaaaggacttgggtattgtgatctgagctgatggcatcacaagcccagtaactctgtgtttcttgcagactcataggaatactgccttgattatcctgaatcaaatctgggagaattctcaggattttcagatactcttgttctcatcccttactttctccaaaacatacagagtctctctctctgccctgagccacctaaatttgggagtggagtggcacaagcacccctgtggccatcactactatgactttgctgggtcagacctgaagccaacacagcactgggtctcactcagggcttgctgtaaccactccctggctactgcctatgtttacttaaggccctgaggatctacaatcagcaggtggcaaaaccaactaggcctgtgagcttcccttcaaggtaacaagctcccccaggccctggatgagtccagaagtcccatctgagagtcaggaactagagtcagaaaacttacaaatctaccttgtgttctattgtattgtggctgagctggcactcaaaccacaagatatagttcttcccactcttctctcccctttccaaaggcagaggggcttcatgtcgtagccactgctaccacagacccatggggagtactgccagactacctctaatgttcccttaaaacccaaggtctcttaaatcagcttgtcatgaatgcttcctggactcacccttcaagacggtgaactcccctctggcccagggcaggtccagaaatgctatttaggagtcaattcctggaatcagggacaccaagagcctgcttggtgctctgcacccctgaggctctgctggtacctaaggtgcaagacaaagtcccctttacttttccctctgcttttctcaagcagaaggagtttcgccccatagccaccacagctggtagtgtgctgagtctcatctaaagccagcaagcctcagaggctcacctgaggcactcaaggtagtacctggtattgctgcttgttattcagagcccaacagctcttcagttagcaggtggtgaatgctgccaggactgggtcctttccttcaaggcaacagggtgtgcctaggaatgttgtctgggaggtaggacctcatgactctgcccagtgccctatcctgacgtggctgagctggtttcctagaagcaagacaaagtcctcctgaatcttgcccctcctctcctcaaacaaaaggaagggatctcttttggagtggcgagctgtgaagtgtggagttaggggaggggaggtgccagcactccttttgctgccctagctggtgtctcagtatgtcacatgacccctcggtccactgtctctgggcctagttcagcactagaactcacctaagagttgcagtccttgtggcctagactgcatttcaagtttacttgtagacacagagtgtagtagcccttagcagggaggtttgcaggcactcaaattctgacctgtggcatctgcaattcctctctggctagggctgatttagataccttcatgggcaggcatcagctgggtttggtctggttttcttttctgctctaacaagacagcactgagttcagtgacacaattgctgtgttgtcactcccccagtgcccagagctgctcttagcaccacactgctgctgctgccagggatagggaaagggtggcatctgtgattctagacttttttttaatctcttcagtgcctctttcagcaatattaagttgaagccaggtgctatgattgctcgcctgatttttgattcttatgaaggtgttttctctgtgtagatagttgttaacttggtgttcttgctgaagggatgatcggtggcgttttctattccaccatcttaccccaactctcctgaaattcttctaatttaaatgagaataggttatgtgaaaattcacatttttattgttgggaaaattctaattttgtgggtttttgcttttttttctgactctaacccattctccaataccaaatggaggtccaacaactccctttaattctgacactacctagagctagcatagaccccacaggttaagggctcagttccacaagactacgcctacatctcattccagctacaaatggggtctccagactactcacacttctgtccagccaactaaaaattcaggggttctctcgaccactcctcaggtttgataactccctaggatgactcacagagtcctggaaagcactttgctaaagattactggtttattacaaaggatacaactcaggagcagccaaacggaagaaagcccaggacaagatatgagggcgaggtttccatgccctcttgccagtgtaccacgggcagcactttgatgtgttgatgtgttgatttgttccaacccagaagcttcccaaacctcatagttcaagaggggtttttgtttgtttgttttttgttttttaagctttattacgtaggcatgcttgattaaatcatcgtccactggtgattcattcggtctccagtcccctttcccctcccacttcaggagtgaggctgaaagttccaaccctctaatcatgtggtttcttcctttagcaaccagctcccatcttgaaaagatccaacctcacggtcctcaaaggtcacctcattaaaataaactcggcaatatagtttggatgtcctctccaaatctcatggtgaaatgtaatccccaatgttgtagttggggcctactgggaggtgtttgggtcatgagggatttctcataaatggtttagcaccatcacattggtgatgtcctgatgatagtgaatgatttattgggagatctggttgtttaaaagtgtgtggcaccttctccctctctctcccttgttcttgctcctggcatgtgatgcacctgctccacttttctttctgtcatgagtaaaagctccctgaggcatcctcagaagctgagtaaatgcaagtgccatgcttctacagcctgcagaactgtgagccaattaaacctattatctttgtaaattacccagtctcagatatttctttatagcaatgcaagaatggcctaacacactcagataaggtcaaaaggagctccttattaatgataaaagacactcccattacccaggaaatcccaaggcttagaagctctgccaagaatgggcacagatatgtacgtttttattagaccacactaatcatgcaatctttaattactaacccattgagaaaagagctcttggaaggactctgacactaggtcataaagttaaaccagaatgagaaagatactgaatataagtgcaaagaacttgaagccaagtaaaaagaaacaaaggcaacagcttgaaggactgctgggtaccaggcaaatttactcagggagcttgtttcctcctaacatcagtctcccaaagagtgccctttctcctgttgcatagaaagatgaaagcctatagaaagtaaataatttaatcctggtcagccaaatgatatctggaaaatgttgtgcttaatcctgagctgctcactccaagattaagattatagtcattattgacagcttcctctggtatgtaagagaaacaccaaatggaaaaaaagaaaatgggaaaacatattactgtgttcataccttcttgtcctcccccaggagaagtgttctgtcttatctaggcagagggaaggctaagacatgagagatttatgactaaacaatactctctttgagtagttgacaccagaactacataatacaaagtgataggaagacttagcatagtaattctgtgaattcaagcatcaaagactgtaaaccaacattcatatggctttcgtctggaattattcgaaagattatattctcacggttctgtcattaggatctaaaatgttggccattccacgtgctgcattccttggtgatctttatcatgacatctgccaagggaccttgcagatcgtcatagctcaactcacattccccatttagtccttcatggcaccattcatctcgtctgcagttgaggaaatcctatttctgagaaattaaaatctctagtgaagacacacaaaatgagtggctaaagtgagagtcaaatttggaacaccagaacccacatccatggatgttttccgggatgtgattcaggtttggggttggaagcatttaattgacttatcaggatccaaaacttcatgagtcgatccagcagggagtgaagggaggaagtggaatcacaaagtcaagccagttcaaagcagctgtctcatcctgctgtgtctcaaaactgctgtagtccctcatgattgcttcgctcgctcgtggtggacaattagttgtggtggcttttttttttcttttcccatgtgtttatttgttttgcattgctttcccctccactaaaagaaacaagaagaaagaagaaagaaagaaagaaggccaggggctgtggctaacgcctgtaatcctagcactttgggaggccgaagcaggcagatcacctgaggtcaggagttcaagccaagcctggccaacttggtgaaaacctgtctctcctaaaaatgcaaaaattagccgggcatggtggtgggcatctataatcccagctactccagaagctgaggcaggaggattgcttgaacccaggaggcagaggttgcagtgagctgagatcgcgccacggcaccccagcctgggcgacagagtgagactccatctcaaaaaaaacaaaagaaaagaaaagaaaagaaaaggggaaatggaaggggaaagtgaagagaaagagaagagatacctacaattgtttccaccatggtgctgttgggttaagcattctaatttggtggtaatggtgttcagaggcctcagattccaacttggagaaatcggatcctaatgtaaccagtgcagtgtaacaggtgatttcgtgtaaagatgcaatcacctgctttcatctgtgaaaacactgtggtggctaggactacaagctcattggtacctaccttagctaagttgaacttgacaatcccatactgggtcacttaccttaagaaggggctggcctcttctgttttgaaattcaggaaaatgtgaccagcatttaatatcaacacagaccttaagtctgataagaaatatttacagtctattctctctgaagcctgttacctggaagcttcatctgcatgataaaacttttgtctccacaacctctaatcataacccagacattcctttctattgataataactctttcaaccaattgccaatcagaaaattgttaaatctacctacaacctggaagcccccgctttaatttgtcccacctttctggacccaaccaatgtatatcttaaatgtatttgattgatgtctcatgtctccctaaaatgtataaaaccaagctgtgcccctgacgacttcaggcatatgttctcagtgtctcctgaggcctgtgtcacaggccatggtcactgatatttaactcagaataaatttcttcaaatattgtaaaaaaaaaaaaaaggctggaaatattcaagcctgaaaccactaatgcgtgttggtaaaaccactgaacgaacatgcctttggcttttagggtcttcctaactgttgacaaatcattgaattgctagttaagatgtccaaaacaacaatcaacacccttgtaaaataaattgaattaatcgagcactatccttgaacagaaagaatatgctatatactgtaagggaggaaaaatatcttttccttctactcatcttaggtgcattggctgggtccctgtaatgaaacacagattaacgagaggaaaccacataaatttatctcaaaagagttttacctgacacagaagccttataagaaaatgaagacccaaagaaacagttaaacctgagtgtttttatgatacgtttgttgaagagtgaaaagtcataaaagaatatgataggacacaggggtatgctctcgtggtaataaactggggagacttagcaaggccagttcctttcagtcgtctctgtgtccctgtgtcttcagatgtaaggatgcttctttcctccaggtatagggtgggcacctctcaaatgagggtcttatgatcttcacaggagggtcagaaagcccttcctaggttttatgacctacttaaagtgatggtcagaaagttctccatgcacattctgtttctcaaattccctcagcttaacagatccaatatgccatatgccatatgccatatgccatatttgggggtagtgtgtcctgaacctcatcagtacagaagtatattagcaatttcctcaaccaacaatttaagagatgcaggggtaatttcaaatatatgctaatttagacccagacctccccaaaagaggcaagtgcatttgtctttaagtatcaattctttgaaacctattagccactgtttatgctacatctaacacaaaaagaaaggtagtttggaaagaactctacttttttcctagaaataaaaatacagttttttattcatccctctccagcctcctacaactttctttatgtatcaggtctttttctcagctaagaaacatgttaatgatcttattaacatattgaacaataacccaggaaaggctgacatttcccaaagcttttggtcaattttcaaagtaatgaaagttgccagttattcaggccaagcctataaacgcctgaaattcacttactgtctgaaaggtcaggtaaattagaggaaaatatagggctggccttgaagagtatgaatgtggtgatcctgagtgctcttaaaagtggctgaaactaagaggcctggtattaattctagctgacttcctggtattgattaagaagtaatcgcaagtgctcatttgtgggtaaattaagagacaagtcctttacagaaggtcatttacatgtcttctttttaattaatattactgactggaagatttgcagttaaattagtccattaattataaaagttatcattctggagagtaggaaaggatcatttatttaatatcaaatccaggttttcaataaattgccatttcttctgacactctactaggaaaagtgtgaagttttgatttgtgagttgaatggatgatcatgacctctgcagttctgttttgttgttactgattttattaataaatgtaatataaaaatgtaatattaaaaactgaaaaatacatttaattgttaagaagaaagaaaaatctatctttctttattttattgctcaaaggtaaacctaacattttagtactcccatttcttaagctcagcataaatataaatatatgctttctttaaatgtttcattacttaaaatatagttgcatttttcactttttcatataataaaagcattttcctatgtcataaatgttatttgaaaaccatgtcttaattaaacttcactttgagattattgtaaattcacatgcagttgcatgaaataatacagaagatcttgtgtaccctttttaattttactgtttttaattttggtaagatccaatttattttctttttactggtagtacttttgatgtcaagtctcagaactccttgctagctccaaatcctgaagattttctcctacttttttctgaaagttttacagatttatgttttatatttaagtttctcccaatggtaacatctttcaaagcattgaacagtcaagatacaaaatattgccctcctgcaagatccttcaacttacccttttataaccacacataatttcttgccattccattcttaacccctggaaaccaaaaatgtatcctacatgtctataattgtggcatttcaagaatgttatagaaatgcaattttatagcatatagcctttagggatgagctcttctcattcaggataactctccataattcttcttacatgtatcagtagatcactcctttttattactgagtagtattccatggtagatgtgccatggtttgtttaaccatttaccaaaggatatcttggttctttcaaacttttggccattgtgaatgaaactgctatgaacatttatgtacaggttttgtgtgaacctaagtttttatttctctgtgataaatgcccgagtgtgtaattgttaggtcatttggtagttgtgtgtttagttctatataaaactgctaaactattttctagaatgactgtaccattttacatacccactatcaatgtatgagtgatctagtttctctacattcttcccagcattggtgttatcactattattattttagctgttctaataggtgtgtagtgatatttcattgtggctttaattcgcatttccttaatggctaatgatgttgaatatcttttcatgtgcttatttgctgttgataaaatgcttcttcttgtcttttgcgcattttctaattggattatttggttcttttactgtgaaattttgagatttcattaaataatttaaatactagtcttttgtcagagatatgttttgcaactattttctcccagtgtgtagcttgttttttcatcctcttaacagggcctgtcacagagaaaatctttttaatttttataagatccaatttattttctttttactggtagtacttttgatgtcaagtctaagaactctttgctagctctaaatcctgaagattttctcctacttttttctaaaagttttacagatttatgttttatatttaagtccatgatccattttgagttaattaattaaattgtatttttatttctcatataagataaaattaatatgttcacaagggaagaacgttatgtgtgtggtgtgtgtgtgagtctgtgtgtgtgtcaaataaaaaatgtactgatgaaatgacgccaggagaaaagaggcatgattgaatatattgagtgaaaataaactacagtccatttgaatcagtttcaaaggaatcacaaactctcctggctgcctatatttctttggtgagttctccaaaggtctagcttagtatgtacattaatcacttcactactttccctttattcgtttaagctggagaggtctttgaccaaccaaggaaagatactataaacaacctaagatcaggaaacccttcactagaaataaaatttatgtatataaccaccatagcattttcttcctaggaaaatgtaaaatgatcttaaataaaacagtatatgtgtatttgtttacaagaataattcctctatcccatccttataccattgctgtcatttctttcacttatacataagtatatgcttgtgtgtatgtatatgtttgaatctattattctgaacacactgttatctattagatcaattaagaataataaaaataaaagttttgttttactcacttatcctctgatgctcttcttttcttacgtaggtacaaatttctggcttaaatgattttccttctttctaaagaactacttgaaaggcaggtctgctggccacaacttctctgaatttttgtttgtataagaaacgttttatttctcctccacttttgaaggataattttgttaccaggaggaggtcccagtctagaccccgagagagggatctttggagctcacacaaaaagaattctgggtgagtccataaagtaaagtgaaagcaagtttattaagaaaatgaaggaataaaagaatggccacagcagcagtgtgagttactcaactgattatacttatacttatttcttgagtatattctaaacgaagggtggattattcatgagttttccaggaaaggggtggacaattcccagaactgaaggttcctccccttttagaccatatacagtaacttactgatgttgccatggcatttgtaaactgtcatggtgctggtaggagtatcctttagcatgaaaatacattgtaattattgtgtaatgaccagtgaggatgaacagaggttactttcatcatcaacttggttttgatgagtttgggccaactcctttaccacatgctttattatcagcaaggtctttgtgacctgtgtcttgtgccaacctcctatctcatctgtgagtaagaatgcctaacctcctgccaatgcagcccagtaggtctcagtcttgttttgtccaacccctattcaagatggagttgctgtggttcaaacacttctgaaaatttcagagttctaggttggtattttttttttctctctcaacactttaaatatctaactctactctctcttttttactttcatgttttctgagaagtcagatgtaattctttgctcctctgcagaggagctttcatttcctctggctttatttaggtttttttttttaatctttgattttctgtagtttgaatatgatataaccagttgtaggttttgtttgtttgtttgacgtttatctgttgaagttttatgagcttcctgtatctgtggtttagtgtcttacattagttttggggaaattcacagtcattgttgcttcaaatattgcttctgctcctttctctttttctgctcctctggtgtgctcgttatgcaaatgttatggcattcttagttgtcccatggttcttgaacattctgcttttttttttttttccatcttttctctcttgcttctcagttttggaagtttctattgtcatattctcaaactcagagattattttctcatcagtatccagtctaccagtgagtccataaaaacatttgtcatttctgttagtctttcttatcactagaaattttttaaaacctagaatttccattgctctttttacatcgtctatcttttcttgcatgttttctacttcttccattaagcccttagcatattcatcatttaaaaaaattcctggtctgataatttcaacattcctgccatatctgactctggctatgatgcttattcaacctcttcaaactgtatttcttgccttctagcatttgttataacttttggttaaaagatagacattatatactgggtaaaaggaacagtggcctttagtaatgtagtggtaaggtgtaggagcagggaaagataatcatagcttcttttcatagctgactttaagtgttatcataagtgctgtctcatttaattgttagaacagtccaaaagataggcaccattatctacatgtaacagataaggaagctagagtttgcctgaagtcatatggctaattaatggagaaacctagactcctcccactcaggtttttttgactcaaaatctacttaagcactgtgctacactgagttatgtaaaaccagaaactacatttctgatccatttaagttttgtctccactacttaccaagtttgtgacccaggtaggttgcttaacataaaattccaggtttctcatctgctaatggggacaataatagtccctgcctcatcaggttgtgataaatgtgacaataattctgacagagaaattaactgtatgaattacactacaggtaatacttcaatttgcataaggattgagaagggtacctaatagaaggagacaggtggcaaaggagtgaaagagtgagaaggaattggaaattgccattttctcttcctttttcctttgttgggattctttttgagccatgaccactgttttcccaccattcttactatccacagaggagacttggagcaggaaagacaaataattattgaacacttactacagtgatgtcaaaaattgttgtaagcacttttcatgtgttaacatgacataattgacaaaaaaaatcatataagtaagaaaactgaggcgtcgaggaaactgagacttgaataaagaccatagcttatgagtgctatacttcatgtgtgctttatttttgaagaggctagtgtttgagttctcttgcctctgagacatttcttgttcattaatttctaagcactctctcctcactggggtgaagagaccacctggagattcttctcatcaccaaaataggtaggaagggtatccactgattctgccattaacatatctcagacaggcccttcagaacgattcaactcccattgattttcacagagaaaagccccattcagatggaaagcaaaggacttatttgttcctgacataaactggtgtttcatgctggactcagtaagtgctgtgagtggggaggctgaattcagatcagtgaagaatccagagatcattcttaccaagcaaacacattgtgtggcccgctgggcacagatactaaaaaagcatcagaggcatgaggtcatggttgttttcagactatccagaaatttattccagaagtcctattcagcactaaactgcagtatttcccagggtggaggaaggagacaacagtgcattatgacacatgtctaaaggcgggggctttggggacagactcctgggctttgcatcccagcttcacctgctaactctcaggcaagttacttagctgtgcctcagtgttttcatctatgaaaagaacacattaatagcactttctatcttagggtggtcataagtattaaatgagacagcatatgtaaagtgtggaaaatagtacccagcacaccttaaacgaaacagcaaaataataattcacttttgctgaatgcaccttcccatagggtctcagtgctaatttcagacagtaagtcaaccactgttgcctctatgttgccaaatttaacaattaaatctgttcaacatgtcagtgaaatacaggggaatttagcaagtttttaaaggcattttccaaattgctaattgtatgatttgcacatgctacagctcaaaggaatggtgcactggtagccagagctaggaaagaactaaggaagaaagttatcttcctcaagaaaagcctcctgcttctttcccccaacgcctcggggcaactgggagatataatggacagaatacacaatcgtgaatgagaagttcggtgttcaagttgtggctctagcacttaattgtgccagttactctgtctaaaatttaatttttctatttgagaaatacaggtaacagcacccacacaagtaaatgtatttaaatgtctttaaatgtctttttaacaaatagtgccctgtgcaaatgctacctattatttactacactgatgcaatcattcaaatgcttatgtcctgggagggtctaagtgcttatttacagcctgttataaattaccccagaatcaggctgctttcctcatagacctggctgggaccagggatggtgggtgatgggagagctttccctctgctgtggtaagggtaaagaataagacttcttggaacatgaggtactctggagctgggatgggaaagggtccagagagaaagattgtaggattctgtgagtttcacatactttgaaatgtggctgatgcaagacctgataaaactgttcatcaagatgactgagaggatgatggtgatttcagtaattacaacttacctttcacaaccgttttcaagcttaaaaatctccttttctcttgaaaaactcatcatttcctggtaaaatagaggacaagaaatacactttttgtcatccttagattgctagtttcatggtggtttgaaggaaagaccaatgtggtaggaggcagcagggtactggagacagaagtagactgcttctaccccttactggccatgtgcccttaaacaagttcccgaatccaactgggacgtggtttccttatccttaagaacagcagcacccactgcaaaggctgtgatcaagattaaataagatccttcatccaacaggccttcttcctggcactcagtaaatggagtccattatcatcacagccacccagatctgtcaaggtatcttgccatcggaagcactatgggagatctataaatgctggttacgttccattcatggtgacttggattattacactgcttcacagagtgggaagctgaagcccacaaagatcaaagggcttgatgaagcctataaagccatcttgcacatcagctttgggaaacatcacgtaaggcatgggcctggagaggaaagcgggcccacatccaagcttatgtcagtcagatgctaaaatgtcattatctctacactgaattaagtgcttgtatatgttgctgcacaacaaaatgcattattgatgtactaaagttttcccgctgggtttatctgtggtttgcatagcgaattttgcacagcgaattttgcacattttgtcatcacctgtatttgaaaataggatgtttcttgacgaatgatcccattatctaatgagtttcatcattaagttttttcatttccaatctaaatgtttcatttcttgactgtataatgttacttcttattatacaatgctaaatcattgttaagtaattcttctagcctgttttgttactgtcttccaaatattaataagcagttatccttttttctcagtattatttatctgtaatctatacatgtgcaatgttcttaatgtctttgcatagctcatgcttttaatcactgttatcagtttcatttgtgttccagtttatcaagaagttcttatagatttctcatgcataagtaatggttttagacaacatcctattcaagatgatatttttttacacccatatattggtgtctatgtctctcccaggatagcaacctctatgagggcaaagactgtcttttttaaaatttcttcaatattttattctgaacacctagcatagtggctgcaatgtagtcatccttgatacatatttgttgaatgaatattgaatatgtagctgaaattcattttccttttattaaagcaaataattcactaagctctcaaatatctatttgtaaacattttctccctcctaacatttttgtgtgctacctaattaatgtaagacatagccccaggggttggcagtagagaaatgaatcaggtcttgcctgtccctgatgggaagtaatcagataattctagtaatgctggcaaatcacctggatagggtgactctgtgccaggctttgtttaacacctcacttgtatggatgtatttcatcctcacctctacccttttttgcatgatttttttatatttccttatctaatatacaccataaccctagtgagtaaggtaagttaattagccgctctatggctcagtttcttcatctgtcaaatggagttttatttattgaatacttatattttgcatgcctactatgccaggcactgttgtaggcaatagtgatacagcagtgaacacaatgaacaatgctcttgccttcatgaagttataatacatccatagcagcacatacttcataagattttggggaagattaaatgagatgatgctagtaaaatcaccaagaacaatattggcacatagtaggcactccataaatgctaggcattattttcatgcaaagacatgcatagaataagtaggcaaatacatgctttctgttgattctgagggaatttaaggaaagcaaatagttaatgtaaaatcatcactctaaaaaattaaaattgttgaactatgatgaacccaggaattttggggtaacatatgcttttttagactggtaaatactaatcacagtattttcaatttgtttcttttcattaagcatatgaatttataaaccttatatatggatctgtattcaaaggtttgattcattatggattttttaaaaggtgcatactaatctttctaatgcaattactgtagtctccacttatctgtggttttactttccatggttccagttacctgtggtcaaatgttgtctgaaaacagctgagtacaataagtataataaaatatggagagaaaaagagagaaccacattcacatgacttttattataatatattatagtcattctattttattagtaatatattgttaatctcttactgtacctaatttataaattaaaatttatcataggtatgtgtgtgtaggaaaaacagagtacatatagagttcagtactattctctttttctggcatccactgcaggtcgtggaatgcatcccctgcagataaagggggagtactgtacattagaaaattgtttgagcaagaagtagagcctgaactataaaaacatatgtaggatggagccctttcttccaactgaacacaaataatgctctgcaataaaatgaggtataagccatacagcagacaattataatgggatttaacctaattagtattggagaactgagagtcttcattaaaagtagcacttcataatcatgtaatcaggaagctttggttcttaaaggctgacaggagatctgatccttaaaaaaagtgtttctaaattttccaagtgtattcagcaaatcgccaaaacgtgcttgattaaaactgtgatggggtgtgtatccagaacaccatgcatcctctactccagttcttccatcttgattgctttccccaagtcactcactgaactctcatcacccccaagttctgcaaacattgcttgttatttcaaaagctgaattaaatgctatcagttgtgaacttcctcagcttaccttctctttctgaaagcactccctctgtctgactcagagaaatctgcctccacccaaaaccttcaactccttctagaaatcacatatttcttcatctgtttttctcccccaactgctagatctttcttttcatcatataaacaagcctcaagcttcttttttaatattaagagaaaagcaactttcctccagctcttatcctgtatctctcttctatcagccaagtttctggaaagagaaatacgtttttactgtttccatttccaagtcttccatttactacccaaagaaagggacccttgccattccaatggagctgctctctcagtggccactaataaccacttcatgtaaattcaagccaacacctctccgctgtcaggttccttcttactagaactttctgtaggattagaaacttttgaccatactaccatcaactctttcgaaaacccacatctccagagagacattgttcctgacttccacaccagtgtttcaagctatgcctactcttcctcgatgtcgcctctgtaatgtcttaacatgtcagagattaaccttgcaatcccctctccaccctgccccatctctgatatttctcaccttggtgagggatgctgtccttcacccatcgcctaatccagaaacatgaaaaatctttccataccctccctactgtctatatccacaatgtcctgatgtcagaataattttcctgagatgaaaatatggtcatgccatttctgtatttgtcactcttcagtggcttctcacagcttttgaaagaaaagccaaaatatttagcaagatactcagagtccctcgtgaatttgcccttgctaaattttcacttctcatgttaaccttctcccacatgtatttgtcactccatctgttccaaacttatgttagcttccagagacttctgttctttcacatctccagaacaatcctgctccccctaatacctaatgaaattcttgtcttcaaaactcaatttgagtgccacctcttctgaaaatgtttctgctaaaaatttctcttctcttcagagctctcagccaccctactgccatcttaatatctgtgcattagctcatgcctcgtttgaaagtctctttgactaggttttaagtcacttaagggtgagtacagtgtcttatcgatgctttaatcatcaagtctatcacaatgtctgattcaagttaggcactggataatacatatattaaaattataacactatgtgcatagcccagtgaacactgaaatgacatgcaccagtgccccttgtggtacattcagaaacactgcaagtgggtcacacccaagtgaaccctgatgcttcccttcatgtggtggcctctcagtggctatctccatttctcagatatgaccctctttcttacaggaaggtgatcccataaataagagcaaccacttatattgatttagtagattcccacatctatctccatatttctaacataacatttatatatttttaatataatctgctaatatgaaatttttgtgtcttcaaaaattgaagtgcttattaaccctttagagaacacaactgagaaatgctggactagagtataaaatgaaaatatcaagataccttttacatatattattataaaccttgtataattttcttccttcaaatctgagcagaaaacaaagtttctctgggtttgaagtagaaaagttatttgaatagtaatcttttaagatagttgatttacaaatgtcttttttttctttgagatagaatcttgctctgtcactcaggctggagtgcaatggcatgatctcggctcactgaaacctccaccttccaggttcaagcgattctccttcctcagcctcccgagtagctgggattacagccgtgtgccaccatgcctggctaatttttgtatttttagtagagacggggtttcaccatgttggccaggctggtctcaaactcctgacctcaggtgatccacccccctcggcctcccaaagtgctaggatgacaggtgtgtaaaaatgtctttaattaagaattaagtttaagtgttcctgaaggatcatgcttctcacagagagagtacattcacatgctgatttttagtaaatttaataaaaatatgcccctaaaatattgttttctgcctaggggaaatgccccatctctattttatgctgcaatgcttgccctgggaatggaggcagagtggcacttggctgcagaggcacagcagggtggatcaatggttccttgttttgggtgtgtagaggccgtgaagtatgggattagagcagggccttgggagcctaatactcctaactacaaatccttatgctgccacctactagctacgtgattgagagttactgaatctcttttaagcctcagtttctacatctgtaaaatgaggaaaaattaattcgcacctcgcaggactgttatgaacattatcattttagaatattttgaaaatgggaaaataaaactagttttgaagattcaccctcaccttattttccatatgactatgtcttttgcgttgttattgataaccctgtctgtcactaacatagggtcctgaatgcttactatctcagtaatctgttcttggacgggggatttgtatatacatttatggttctgacttacttgtcaagtcacatgtttctgcattgggcagtaaaatacaatagtaacaataatagtattcaccatgccaggcccctgcatatgttatttctcatctgcatgacagcccccacagggcaggcatcagtggctgcaggagagaggggcaccacagataacagagagaaatagtgagctggagggcagtctatgaaatgcctggtgaagtcgtgcccacaaccttttgggaacaaagctgccaaaagtccagctcatctttgagcacagatgccacgctgtctgtcatggacccctccaacttcagccaccttattgaaggccaacgtgtctcacactggcagaaccccacctgttagaaacccctgaggcctttgcttagcttttggagggggaaagaatatgaagaaggcagccattcctacaagaggtgcctgtcatttctggtaacctccccacttctctgtcccttcgcatctaagagagtacagctgatgcgggcaataagggtaggagggttcagtattaacttgtagattttggactatccttcctctctctaaaacacaaacaaaaaatagggtgaatgtaggcatgtatgctcaatttaactgaaaccaaggaataagaaatgcaattgaaaccagcccaattgtctcatagaacatatatttatggtttctgttgaataaacatagaaattgaccctccccatcttaaaacttgagaaacttacaaatgtcttatctgaggttttttttttcctcaggaaaccaacaatcaggcctcccacatagatcaaggaattgaaacttaccagatcacttcatctggacaatgagatactagacaccttacccatcatgagtgcctaagcgaccacctgctattgggttaccagctcctcttccatatccctccctaattcctgttttcccacacatgattacatttctttccagctatacaaactcttaattttagtacattagggagatggatttgagactgacctcccttctccacagctgcaacaaccaattaaaggcttcttccctggcaatacttgttcgtctcagtgattggctttctgtgcagcaagcaacaggacctagaccaaacccctggcattgtgataacataattacatagacaactgttattctcagaaagttttgtccacaaagagtagtagctgcacttctcagagatgggaagaggtgggccctggtggggctctgcagggacagctaggagaggagagacagagatggaaaggagcaaagtcatgcttgcatggacttgtggtgaaaattctccaaaattgcctttaaacaaagaagagaaagaggagggtgagtgaatggagttacttgtatgggataaaccaaacaagaatggactttataactggccttggaacagcatggtgaacatggagagagaagagaaaagaggaagagaagcagggaaagtagaaagaaggaggagaaaaaagacagaaagaaaacttaggatgctgttttacataggaggctaagctcagagaaggaaaagataaaagctcaacattcataacaagacaagagagaacctggggattctaatttacctggggggtcgggggcatgggtcaaccatgagaaagtgggcatgagggaggaaacaaacatcacctctgcagagaccttaggcactggagggactgtgacagggtatggactgcatccgaagaataaaaaataaatcaaagatcaaataaaccaggcaaacacaggaaacacctgaaaaatattttaaatgctctaaatacatgccttgctacatgagatagtgtctagttgtgagctctctcaatcattattttactctgagctttccataaattgtagtatgaaacatatatacatatgaagagattctgatgataaaaggcctgatttgtgaaagtttgaggtaacaattgcaaagtcaaatcctgtgcttcttaaaggagggtcctcccttccaccagctggtgacctcgggaacttccttctgcacagcatgcctgaatggatttattgttgggaactgcttaggaaagtgctatggtcaggagatttttttccaccccaaaattagtatgttgacagcctaaccccaaggtgatggtattaagaggtgggacctttggaaggtgatcaggattagtgtccttataaaagagactgtgagagggctcccttgcccctcctgtcatgtgaagatagagtgagaaggtgctgtctatgaaccagggagcagccctcacaagacaccaaatctgcatgaaccttcatcttggactttccaacctccagatatgtgagaaataaattttgttgtttataagccaccagaccatggtattttgttatagcagcctaaatggactacgacagaaagttttatcatattcccatattgttgtctcttaatgatactaatcagtgacagaattttagcagaagccttactataatttggaaaaatccaagacaaaatatctgagtggtgactttgccctgtctacacagaatagaccactgcccaagcagtctgcatatacaagttcagtctgcaccaagttcagaatggagccgtgtgataagaaactcaaatcaaagtgatggtagctgaagatgattccagctggcaatgagaaaatatacaactgattttattccttcttacagtttcaaaaatagattgaagttgagaattgtactttgagaaggccaagtttccagctcttaataactaacttatttactgtactcatttcacagtctgtgatgcagcaatccacaaaatattctatatcagtctcatgatgaactattaaatgaagggacatactcattttttgagtttccaaaaattatagaaataaggtagcctgtgaagacttacatacacacatgcacacacatacacacatatatatacccttaagcacacatgctatcaatagctctcatcagaattttcctagtataagttattaacaatggtgtaaaatggacaataatgtttctccttgtactttcaaaagatgaaatttacagtagtaaagagcatattttaaaatacaaatctctgaacaatgttgaggttgaaaattcatgcccatggcaatgccaaggcaaaataaaaggtctcgtagagaataatcttgtgtttgtgtattgtaagtacctctaggggagcattttagtgggcatactttcattgatgaaacttctttttctagtcaggaatttcctcacacatagagaactgaattaattttatactgatattgtaaacaacaaaaaatcatgtcactggtatacagtttgctacaaaacttagaaatcccaattaatcttatgttcatactgtataataatagtaattagtgatgttaaattgatatttgaaaatgcctaatagttacctaaactcattttattgtgattaactctatactctctcacttataattgcttgaaagttgaatttttgcttccttgtagtaaatgagctttcttattttacgtgaaaattttttttccatttcacatgtataactacagctatcagttttttctgaaaagtgggaatccattatttttttggaaaggtatggtttcaagtttatgactctgttgacaaaacaatttttaaataacaaaatctaacagcagacataactaggtatgaaacaaacatttgcctctaatggataaagttcagtgtctctcccaaagacttttcatcctttccatttcctggcatctttgaagaacatccctgaggctgctctgagttcctagtgacaccccttaatgcatggatcaagcaagccgtggaggaaacacagcacctgggcagtaggatgcccatgcaaataaatgagcttcctatctctgcaaaccttgctggaccaggtggttttgctcttttctggccccgcaagtaaactgcagtaaggagacactaatcagtttactgctgagaaattggaagctctttcagcctgaagtgtcttacacagaaaaaaataataaagccaagcaataatgctcccagggaatgttctctttatctgtatttagtgttccatcactaggaatccttagtcctttgttgctactattagacgagcctaaatggacttccaggcttacttcatttgactcaagggggtactagaattcctgggcatttgtcattaattcatttgggagattcaaattgcacagcgatggttcaaatagtacagcagaaagaagcctcccagggcttggctggatgcctccggtgtctggggcctgggagtggggtccttctgtcccacacatgagagtgaggccaacgaggggagatgaggaataagaacacacaggaacatgtaaggtcaggttccacaaggtgagatatgcaacctattttatgttgacccctctgcctataacacattataaacaccattctgggaaggcagagaaatgtacttatggcagttcttcattcattcctaaaggactcgccagttgattcactatctctgggggctttaatattctaaagctgtggaacagctcacagtgtatgaataacattttctgccttgtggaaatatgtaaaatcttggaaatgtgacttcctccaactatgagtgttcctagtatgtttgactcctgtttaaagaccttgcaaagaaagtgaatgattggctcatgctaataaggtttgcaagctcctcagggaaacaaaaaattaagcagtgatggtaggaggaggactgattttggataaaaacccatctccactgtttttctcacacttgtcattttgaaaaaaacactttctccatttttcttattaatcctcaacctcatggcagggtttcctaatctgagaagtacattctacatatgtagaacatacagggactagtgttgcagagcagtactttcaaatgagagtcacagagaggcaaacaaagctagagacaggatatggtatgtatcatcaacacttgacttacacccaccattcaaaatcttctgtattatcttggcaacttgtgattgaaacgtctacatgcccttggaggagtagatttaatgagaagaataactattgtgtgggtgcagaactagagtgtatcttcgtctcctttaccccaaatgccaaaaatggcatcacttattagtattgctgatgctgtttctttttttcaacactaccccaatttaatacttacaaaaaaagccagcccattcctactgctattgatttaaccctgaccccacaaccatatatattccttccctaaaccccagtatagcttttgtgtacctcagtcaccagtattctgtaagtgcagcggtagataggtcttgtaatcccaaatgttcacaaaagagactaggggcttgacaatctctgtgctcctcccaaaggcaattctggcctcattgtttgttttcttaatgtagtgttctaaactaattcagactcttttacacctaggcttttctagaaaattgccctgaagaaatttgtaactttctctgcaagtgtactatctcatcactcttcttacatctcaaaattagaaaaaaagaactcaaaacctcacactatgccctttgatttaaagtcagggaactgagtgagatcactgtaggctgaggcagacagacacaggaaagcagacagagaatagaaggggaccaatgtttgagccctgggaactccaaaatatggaaattgctttgggaagaagcttccagtgagatataaggaaaaccaagagagtgttgatgtggaggccaagagaagaaagtaattccagaagagaggtggccaaccatgtcaaatgctactagaagttccaatgagataaggttagaaaatagaccaccagatttgacaaaatgaaacccatgtggctagagagacagaaaaggaatgaaactcacagggtttggaaggaatccctctcaacaaagagagatgaggacaaaatgaaaaaggagtaacttgcttggaagagttgtacagaaaagagctgaaaagtgaggcagtgcccagaagacatagtttacacggagtttttggtttcttatttgtattatgtacagacaatattaaagcataattgcaagtcgaggttgttgttgagaaaaagaaattgaccttgcaaaagagaggggaaatcataaaatcaagatttttgagtggattagaagtgataaaaatagacaagttggtcatcagcaggaacaagcaaaaagagaaaagggggaggatgtgggtgcagagagtataaatttgagttagtttagtgatgagaagtgaagtggtttttttctgattacttccctttttattaataaggaatgaggggggccataactgatgaggaaaagagcttttggacactgaggagagaaatataagtcaataatcatcttggagaatgggaacacaaatgtaccaggaaattatagtaggacttctaagctttaccaaatgtccattcaaactttgtagtcataaatttagcccttatctctaatttgacgtttagcactgcatcacattattactaaccattttgtatgtgaaaatcatatttttcccaatcatttacaagtttctcaaaggtggaatcccaaggttgtactaattggtatcttctccagggcatacttccgtgacctggcaagtaggtgcctgatatggtttggctttgtatccccacccaaatctcatcttgaattgtaatccccacatgtcaaggaagagacctagtgggaggtgataggatcacgggggcggtttcccccatgctcttctcatgatagtgagttctcatgagatctgatggttttataaggggctcttccccctttgctttgccctctctctcacctgccgccatgtaagacgtgtgtcttccccttctgccatgattgtaagtttcctgaggcctccccaggcatgaggaactctgagtcaattaaacctcttttcttataaattgcctagttttgggtagtatctctataacagtgtgagaatgaactaatacagtatctcataaagatttgtgaactttcagattgaagactgaatttaccattgtgaattaaatgcctgaggagatgtttctagcccttctttcctctgccctgacccatattaaaagaggtattcatagaaatcattgctctttttcctctgcgcgcacccagcctggcaaacacgtctggcttagccctcatatcactaaaggtatccgtgggattcctctgagcaccccagaggtgggtctaaattctccatctactcaaatatgtcctctactcatcgaatctggtctaggacctgaagaagcactggtgtgaggtggctgtttctagtttcttaaatcgaagctgaaaactagggccagttctattcagtcatgtttttgtgtccacattctttaaccccagtaatgtctaaccctcagcattatggtagtaaaagtcagacactgtgcctgagaaatagaaaagcctcatttatttattttttttttttagtcccttgcttctcaaagttggtcctaacaccagcagcacaagtactatcttagagcttattagaaatgcatcttggttcttgggttcatggattcactccagacccactgaatcagaatctacactttaacaagatgctcagatgatccttacaccaccaaaatttgataagcactcttctagatgataaaagaagctcccaaatacagttatgtaattgtgctaacagaaagctttgaaaaataaatgaaaattttaataattgctttgatttttgttcataaataaagacacactctattgctgtgtgtcttgctggacctaaggaacagaaggattttttgatagctgtcaggaaagctgaactctgtttaatgtaggctgactcttccatgtaattgcagctaaaaagttagctatgaaataccttatcacaataacagaaatgctctcagtaatccataaattctttgtagcacatttgctttttgtaggtttttgataagtggttgggaggacaaccagcagtcagaaaaacatctgtattctttaagagcctgactctagacagactcaaaattcctggacacagagaaatgtttcctgggcattcagatgctacttagcaagttaaatagctcattgattgataaagtgagaggcaagattaggaaggggttagttatctgagtaacctattcttgaatatggaaatcacataattattttcaagagaatgtgtgtgagaacgaataaatgaaaaagttagatatagctttttttctgtgctacaaatcttatatgtttattgaaagtcttttctctaagactatgatgcatttggctaagattaatttcagaaattttacctgtatttttaatctcatttagaaatgaatagtagccataaaagaggcccttattgactgcccagagtggtgggtcacaaggtaacatgttctgagaatgctgggatgcaacctgccaagagatatatggatgaaacaaatcagaccatgcaaccgcactgcactcctgggaaaaatgctttttaaaaaaataaagataatacatgttttttatttaaagtttagaagttgagaaaataacgatgacaaaaacaatgctcctacacccatctgttctgagcttaccacttgaaacccattattgaaatagaaaccagtttgtcactggtaagcttgaggttcctacatgtcaccatgtagcatgacatagcagaactgtcatcgaaacctcagtcagaattttgtatttctcaacaaaacgtatacccataggatactaatgggcacagtccattacaaagacataatatcattttctatatttattatcataacacattctcacacctatagagtagtttgtatttaatattgtcttttaggcttctgattttgacattggataatgttggtgctgacctctgactgccaggttctcaaaggacagcctcatttttataatttattccccctttcttggtctcttggtacaatgctaaacaatataatgcacaaagcaaacaaagcaaataactgaatatacacctttttgctctatctggtaaggcaaatatacccacttaattcacaccttaataatttattttaaaaaatgttaatctcttttctttaggagcttttcccttggctccttttcctgcagacaaagtaggtagtttactttgtccaaagtcgtgttaagtacaaatgaaataatgatgagctttatgtaggcagattcctccctcctttttatatattaccatttttctcaattagtttatatgctaacatattgtaaacagaaagacttgttagtaaatacaaaaagaggcatgcattttctataataagattgaataaaataaaaaatttattggaactatctgaaatttatatattattaagcacaaaagggacaccttcaggtttttgttcagatcataattttggagcattttttggttctagaaataaatggaaatgaccaatgaatgttagtgctaaaagaatcctttgatagcatctttttttggcctttctttaagataacttggcaccagaataataaaataatgtaaccacatttattcaattagagtatagtggtttaaatgcacagttgtatttttttcacctccagtatagtaacattattctacaagttagatatgactttacaaatttaatgtgctaagaataaaaataatgcacaatcagctaggaagttaacacactaaaacataacttaaagaggtgaagagtaacttgtccaggagtgattttctgcaggctggcctcccaaaggaggagttggcaacatataagtctccaagaaaattggctaaagctgaatgtccaaggcagttaatcctagttgaataccgatgtggagaattgggcccaaaacccactatatcataggagctgcaagagtcaagctttgatcctgccctctgatcatgctgggaacagagctgttggttccctgattgtgcagcttaatccaaggcctggatcccctctccacattccctatatctgaaggaactgtggattccctgtctcagaacatagggggcaatagggacctgcacaactgttcctcaaataaaccctgcttcagaaggtccattgtgtgtgcttttgttgcacaacatccacttgtggaattttcctatccacattccgaacgttactaagcatgcctttctatctcttaagagcttttcttgttcttatatataagtagttggatctcttgttgttttttatatataagttgttggatctcttgatgttttaataaagtaattgttgtgatgcaaaatttctttcactgaaatgccagatatcttccacttgattttcacccttctctttcccctaaatgctcagactacattttcatggattctattaaaggacacccatgctctctgggttccagttagttttggtgaataagaagacccagtaatggatggaaaagaaagaggaagatgaagccagggattttattctcccagcttactctttatgaaaccacttcaggctgctggggtcccttgacttcatgccattgctccatgtggttctttctggctaaactctcactctcttagtcccttcagctttaggaggggtgacatcctcactgctcctgctgctactaggctcctgcaccattctttgtagttcccgtaggtctttttattgtctttatgattattctctttgcaaacaaaggtctcctcaaaatatcctgacttcagtgtaccatcttttctttttgggaccctgatagatacaaataaattaggtgcaacatcctgattaagaaatatagttagatctttttttgaagaaggctaatagtgttttttttaagcctttcaaaatgacacttttagactacccaaataataaatctgtgtttaatatgtctacccttatatctatctctacacctatatccacaattttctggaaattcagaactactacttttaggaactttttaaaggttaggtgaatcagatgttcacataatgaagtctgtggaaaggacaactatagattggttagctttggttgtgactaaaaggttaagtagtggcggcttattgattataaatattgactggcattttctttaataatacttttgatttttgatggttcctcagaaattaatatgtatttggaaggtctttaattttcatcatccacagcaccttgcacagtgttaagcacaaaacagatgagtaataactggttgctgatcaatttgtttgcataattaattgcttgtgcagttgtctgcattctactctgttgttttttatgcaggcaggccatccatagctatatcatctctggaaaatgtgaactctgttgcattttttcattcaatagattaaaggaacacccagagggaaattatgtagcaaatattacttgttggaaaggtctttaactttgcttgattaggttatctgtcacctaagtcaaatcgcagtggtctcttgatgatctgattccagcgctaattcagagccagcaggggaggtggagccaaagagtgtaagaatagagcttgggtggctgttaacagcggaccactcttcaatggattcagatcacagaattgaacagcaggaaaataaggatagttctggggcaaagccaaatctgcagttctttgaagctattgcatgtttatactttggacaaaaccttccttttaccccaaatttttattctatatttttgcagtttgtaagtagagaaaaatcctaccagatactatgtgaatgacagaatttatttatgactctgtgataaatgtaatgaagtcatactgcttttggaaagggatagatgtagggagaatactcagttttgctgaggcttaatttaaatattaattaggataactatccttaaagtaatcaagaagtaaaaaggctgcctgtacaacaaccacaaactacaacttttaaatccttccccttttaaaatcagatacaacagtggattgaagattttttaaattaatcaagtgtatatgaagtgacagattatgtgaaagctcaaaggtcttctcttaagtagaattttgggagggattttgtaaagggcatcattactgctgagcaccaactttgttttgggcatttaaacatctattggggctttcatcctcagctactgctcttatcagtccaattttgtgatgcagatcatctgagattcaaactttcccttgtttagcccacaaagcaatttttaagaaattcaaattttcaattgcttagctcacaaaacaactttcaaaaactatgttctggttaatttaggtacccattcatatgaaattatattctactttccgaaaataatactgctctcaaaatgtgttttctagttgattattaaatctcaaaacttattactttgaaatacataccaaaatctttggagatggagttattatattgcaatggctattatatataataactattatatatcatagatgcaatggcctaaaaatcaaatggcgttttccctcattctggaaaaaaaaaaaaaaaaacagatgcagatgttctgctgcctggacatctctggtcatgtgtctttccatgaaacagttttatcctcccatcccccataccaaccacaattaagaggtttaaataaaataaaactaagaaagtgaatttttagagatgtaacctagtcctgctaataatgtaggaggcattcatttacattcaaaactgcaaaacagagcagagagttaggtttggaatctgtgcttgtggagccttttcatttactcacccaactccaaataagtcatttaagatactaaagagaactagtgcagaagatgatatgcttagacataaaatatatccttatttgaacctataatatcctgttctgaacataaaactcaaatgtaaaatttaattcttatgtttctaatgtttataataaaccactgtatttatccactttgaacaggcttagcttttgcataaagttgatttctttgcaaatctattccattaaacaattttcattcataatatgagcccgtattacattttgtaaccctaaaaatcaccatcggcatcttctattcaacagataataagttgtaaacagagcaaaaactattacggaaaccatgcatataacatgtaaagtaacagtatcaaataaaataaaaaatgaccaaaaatattttaaaggtacagtagaacaggccaatcacaaaataaaaactccaagatagacaatcatggaaagaaatggtactgaatgtcagctccaagatgcatcaatgagtaaaaagatgacttgtgcccccagctcccagcacaaaggccctggcaagcaacttggatgagttcttaatttactcacttgctatgaagtcaattcttaaagaccgtgtgtgggtttttacactctgtatttcaccaaatattagaatgtaagacaggaagacaaacgttgagattcataacaatagcattcacatctacatatggtaatttcttagagctattcaatgaaaacttccacctcggagctgacatcttagaattattttgataccatcccttgcgattctgtaagcaaagttgttaagagtctgcaaaggcataaatgcatagagcagttgtctaaaattcttgagagaaaatagtaaatgttctgggactccatgcagatgaaaagcaaagtggcagaactacttttaaagttgttcatccattaggctaatctctaagccaatcaggttctgaggaaagcaattatgagcaaggtggacagagaacttgcctaagacggaaaggagaattcaacagtatctctgattaagtgctttaagtgctgtgagaacaaatctacaggtgcggtgtgggtttggcagggatctccgaccttaactaggaaaggggtggggatccagaaaggcttcctggacgaaggaatatccacggggaaacctgaaggattagcagaagttagcaaagtggagaggagggaggactgttttaaggagaggaaatagcttactcagactcagaggtgagaaagaacatggatccaagagaaaataaaaattcagtagggatgaatgaagcctgaatcccctcgattgccgaaaggcaagaagtgagcctggagatgaagttagggaataaggcataaaatctaaagtaagtttcattaaagcagttttacttgagacaagagtctttgagattgatgtttcaaagaaactgctccatgcaaaatggactggaggaatgcaggtgaggtaggcggatggctcggattggttatggcagtggagatggaaagaacttgatgcaggtggggtggatttagaggtaatatcgtcaaggcctatgagaaacaggatgtacagaatgagaagtaggaaagagtgagggaccaaagtgattctcgggtttctgatttagacagctgggtgcatggtggtgcagtcactaagaaaaacatcaagggaagggcagtttgagattaacagatggatacgttttgggcaaaatgggttggcaatacttgtgagccgtccaagtactatgtcctgtaagacatggatccgtgtagatccgtggatctggagctccagagaggaacctgggatagagatggagatctgagagtcatgagattacaattggcggttgaattttattgagtgggtgttgtctctctagaagaatgtgtgtcgggagaaatgaccgagggagaaccctacagagcaccataaatgtgtgatgagcagagaaaaatagtcctatgtcttagcccatgttccctaagaagcaagctggaagcaaagctacacgctaaccccttatgggggttgcaggaggataccatggcaggatagaggaaatagaaaaatagaagtgaggtaagaaagtcaagaaagtaaatacacaggggtatatcacctagttagcttcataggaatcacagcctggtgctcagtcactgagacactttcaggaaaaccttaccttacagaaggaatccccttaacaaaaaggtgaatgtacagtttgtcttccagcctcttcccttttcttgcctctcattgatcaacatttgcctcttagccattctagggcttagttaatctaggcagctcttggagaaaccagagcctccatgggtccaggctggttgagccaaggtgctggggcttcttatgccctccccaagatgaacctgagggaggccttgccacaggtcagtcagtaagctctggaagaggctgagacagagggtggtgttgggagatggagcaatggcatccggagctggaattttgtaagttatgcagtgatgtaagcctcaatggattctcttcagccaggaattagagcaagcagttgatgatctgaaacaattttggataatgtgtaaactgggtctggtatatcctgtgaagaagcctgagaatgattggtaagataagtgggagaaaacaaataatgccaaagattgaaagaaaaaagcatatttcaaaaatggatcatcagtgtcaaatgtttctttcaaatccaataaaataaaaactgtaatgtctattgtggattcctgtgattctagtaaggtactttgattttcctgtgggaaaccatgccttgcctattcttggtttatttggtttgggttgagtgaattccacccagtaattcccagggtcagtaaatggtccaactgcaaacaattgtgagtgactcctctaagcataggggtggcctgagccaaacaggccaatgggacttcatgccagggattgtgctggaacaattggtaaagaactgaagactgaatatatttaaattttgtgaataatacctttttcttcttaagccaagtagagttgtttttctgtcatttgtacccgaaagatgcctaattactacagaagcaaaaaaatccattagatataatgacaaaggttattggagccctcagtaaggatggtgtcagctgagcggtgctggcagaagttgggggcattctcactgcctcttcatcttctttcttcaactcttaaaacacggttttatctacttgtgaaaggagggaggaaaatgaactaaatgtttagagtgctcctgggagaaagcagaaaacagtgttggcatctcagagccaccctcttctgggcctcacctgaggaacaggtgtgctgcattgggcaggggctgggggaaggttccccagtgcttccagagtccaaacaggccccatctattttaaacaactgcaaagtccccgtgataatagatttgctcttaattttctatttttcccaagtacttaatcctgtgccagtgggcttttattaaatatagattcatttgagactccccacctacctgagcaaggatcagcccacaagaattactccatctggagttctacagtttctttctgatggctgaaaaaaaaactgcattttgattccaagtttggtccttctcttctggtgactataaggcagatatatttattatcagttctgtgggattctttgcttcatcataactctttatatgaacttgtaataaatctgtcatcacagtctcaatttattttcacaacatttctcttatcaacccttctttcctactcaaattattttctagaattcaggtgctcactacttctgcctcgcaatagagtaacaatgctctaattggtcttggtgcctatagtcactctttgctccaatccgtcatcaagcaaataatccccaaactaattaaatgtgccagcatcagttaaagcaggcagtgaaaaaacacattcctaaatactcctagagaatttaatttatgttttctaaggacacattgtctgctgttattagtattagttgtgtatgcttctgtgtttttatttctattcttctcgattgtacattctttgaggatgagatgggttttagtggatctcatttcataagtaaggcaataaagatacattttccataactaattatataccaatatacagcatgtagatattgagtcctacatttctgattatcaccagttaaggaccaaagtatgacgtgggaatattgagctctcaggtagaccacaggctcttgtcagatgcctgccattgctatgctattctcattattttattgcatagatgaggatagaaataaaggtcagtcctggtgccatatttttaaatatatatagaaaatatatgattggcataagcaccattgagaatattctagaaaaataatacttagctattttatgttggctgaaataatattttctttatgagaaaaatataaatttctattgcaagactttttaacaagaattcttttgttttgtttttgcatgatcttaattgagcatttcaaactgttttaaaaattcagagactctctataagatgtgtattttttaataaaccttcacttgagtataatttttatttcccatcagtacctaaaagaaaaaaaaaaacttcttcgaaaagataaaaggatgcatttgcaagattatttccctcttaggaaaagtgcaattttttacagaacaatgctgatacattttcattttattcaacttatagtttaatttttattcatattttatattcatatttgcatgataaaaaggtgccacattgttcttagcaccttatattatttgattgctaaagaaagacacccaaaaaatcaaacaggaataaaaagattcaagtctcataatggagcaatttgcattactctctaatcttcatctcattaaatcttattgacagatcattgtcttcctagtagaaagtctgtgtcttagtcaattcaagctgctataacaaaataccagaaactgcatggcatataaacagcagaaatttattcccactgttttagaggcttgcaagtcccagataaaggcaacagcacatttggtgtctggtgagggcctactttttggttcatggatagcactttttgtgttctcacatggtgatatggtttggacatgtgtcccttccaaatctcatattgaaatgtgattcccaatgttggaggtgggggtctggtgggaggtgatttgatcatggggttggatccctcatgaatggtttcacaccatccccttggtgataagcaagttctcactcagttcacatgggttctggttgttaaagtctaggacctccctcctcccttgctccccttcttgctatgtgacatgcctgttctcacttcaccttctgccatgactataagctttctgaggccctcaccagaagctaagcagatgctggtgccatgcttgtacagcctgcagaaccataagccagaaaaacctctttttcattataaattatccagtctcaggtcatagcaacacaagaatggcctaacatacatggcaaaaggggcaaggaagctctctagggtctcaaaattttagaaggtcactaaacccatagggggtccatctccctgacctaatcagctcccaaggccccacttccaaatgccatcatcttggggattaggtttcaatgtatcaattttgagagggcttaaactttcagaccacagcagtttaagagaactattacttggcaatttttatggcagatccacaatgtcattcaacactttatgtgatattatctcaataacttttggcctttaatattagaataatcattcaacttttaagagaatttggcatttagaccaattaataaactatgcaaaggctctccccacactggctggcttgtggcttggctgaagcactgccagacataggtgcgattaatcatttgttctcacaataaagataacagtttttagaattataagaaaagtttctcattcccatttttctttattagacataaagtccatgtattctcctttttagtaagataattagcaaaaaaatatttctgaggaggttttaaagagggagattatttggggtaaactgggaatagtctgatatataccagcttgctggttgctggtctggatcaccctggcatatgatgtggatgctcaagctttacgactgcactttttagtgaaaataatttgtgccagagctcttctaagcactgtacctgtaatcctccaaatagctctttgaggtaaataggtaatacttattgttcttttacagaggaggaaactgagccacggacaagttatgaacttgctcatggtccctccaccagtgttagagcaaagtcaaaactcaggtctgatcctgaagccatagatctgaactactatgcattgataacaagagcctgaaagaaacagaaccaggaaagggggaatgtgattttcttcttttgggcacattgaaccaaattctctattgtcattatgaatttgtgttcagggcaataaccccaccttggtttattcagagttactgtgagattcttctctgtgttgggtactagattagtcagctcaggctgccataacaaagtactatagactgggttgcttaagtaacagaaatgtattttcccaaaggtctggaggctagaatctgagattagggtgccagcatggacagattctggtgaggcccctcttcctggcttgcagagggccaccttctgtgttcttaagtagcagagagagagagagagaaccagagcaagctctgtggttcctcttcttattagggtactaatccaatcatgaagcccctactgtcatgatctcatctaaagctaattctttcccaaaggccccacctccaaatatcatcacattatgatgggcttcagtgtaggagttttgggggagcagaagggacacagttcagtccataataggtactcatccaagtattatggtagaaaagttgaaaaagatccagctcttcacttcaaagaaataaaaatataaggggatgcataagcaagttattgcaacctgatagttcaaaaataaaggaatatacaagtgtcctgaaaggaacaaggaggatgcaattaattttgtttggatcttgggagcaggatggcatcgaagcagggtctacagaggaagagactttgcaccaagtctggaatatgtgtggttggctcatgatgaaaaagggtccatcagccctactgttccactgtgagagggtggagtttgttacctgtacgatcttattccagaattattctacaaaaacaagaaaccttgtgatattctgggttaggactacatatagtcaccctagagagaaactcaaaattgacaagcattttctgtggactcaagggttctaaccatggttttaatccctcatctttaataatataattcaagggattacagatttttacagaaagcccttgaaatgaaggatagtgacctaaacacagcataaataaaacaaacttagaggcaacagagatggtagagaaacaagaaaagtctaggggactcctatcactaacatcctaagagaaataagagaatattttgtaacatcagcaaaagaatgaaatgcttaaaataatgcaaaaaaaaactacaattgagttcataaaaattaaaaatattacagcagaaataaagaattcaataaatgagtcaataaaatgtttttctcataaagactggaagggaaagaaaaggcaaatagaaaggaaaagataaaaaagttaaaagaatagttaagaaaatccaacgactaaataataggagttctagaaaaaggcaagcagaaaataattcaagaaactctcctaagacaggtcataagttgtcacactcaaaagcttcaatggcttaaacaaatccactgtcggcacatcactgtgaaatttcagagcagttgggacaagaagatgatacaagcttctaaagaaaaaaaatccactggtcaactacagaagatcaaaaattagaatgactttattgactttatctcttaatggttccacagtagctagaggacaatggtagtgtccttgaagttgaactttataaagaaaatattattcgtttaaaatatagaccaaaccatactatcaatcacatgaagatatactaaagacattttcaggcaaacaagattttcaaaaatttaccacacatacacacacacattctcatgaaacacaggaggcttttttccatgaaacaagggaatgaattaaaaacaaggcaaacaaacaaaaaagaggaactcatgagaaacaggaaacaggaaatctcaaataagagagaggccatgggaatccccatagttatggggaaggacgatagcaggattattgctataggtagatgtagtccaggctggaacaaggatgaaagtgtgtggtcaaagatagccaagggctctatattcatagtcactctttctgtcaattcagatgtgacaaaaagaaacttataaatgcagctgttggggattggtagagtttataagagtctgtataaggggtaaacagaggagcttaaggctatgatgaccatccagctgtttgcagactcttggagtgggtgtggaggagaccaagatggacctgagctgaaggaggtccagaggttccactccctttcttcaaccagaatgagtccacctctgcctcatgcatatactttaaatatatatgaatgaacctttaataacaaaaatattgacagtcactactctctattataggctgtcattaaaatattttagatgggaaagtgatataattcgattttaattttagaatatgactttgattccaggatagagaatagattagagggaagtaagattagaagaaaggaggccatttaggaggctgtggtagtgcaaataaggtattataagcttctgaattttaaatagtcactatagggatgaacaaagggaaggacaatatatccatataaaaaacaggtagaataaatatagaactggtgaggcaaagtgagaaagaatgcaaataacttccaaatttctaatttagacaactatgttggtgatagtctatctgctaatattcaaagaaaatacaggagaaagagcagattggtagaggaagataaagatgcccattttgggcatccagtgggcgaagttttgcaggcaggcggatatacaggtttggaattcaggaaggggatgatgatgtatattttggtgtccaaacaacaggtgtttgcaaacatgggtagatcacctatgaagaatatgtaatgaagaacaaaggggcataaaattatggtggatcatgagcaaatatagggtatgggaagttactaaccctgaaatacttggtccctaggaaagactgtgttagaaataaaattagccccattttctttgaatatccaaatgaaattaaacaagaatcatctctggccaaacctcatgtccttatcccccacaaagaccagagtgatggctccagagacagatctcaaggagaaggtggaagctgagagaagtgctgtggcagtggcctcgccttcatggaaagctgcagtacctttcaggagccgattttgctgccattttgtgccatgactaatattgattcactcttcacactccctgttttcccatttacataatcagattcaacaacttattctcatctcagccttgaaaatcaggacatagatttttatgcttcagagtatttttgtggcttgcagaatttcagcagctgttacttcatacatcaggaaacattagcaaattaaagaaacaaagtttgctgagaatgtgtatacatatgtaacaaacctgcacgttgtgcacatgtaccccagaacctaaagtataaaaaaataaataaataaaataaaaaataaaagaacaaagaaagaaagaaagaaagaaaaaaaggaaggtaggtccatagcattagagaatcttatttggagttctgtggcttaggccaactagtcttgtaaattagagcttcactttatagatggtctttatatttaaaaatcacattttccaaaaacatacattattttaggttttgaatttgcgaattgcgataagagtgtttgttttatggttggttactgtaaaatgtctagtcacaaccactcccctggtccccaaacaaaatagagttctcaggcttcctataagctcttttgtaaccttggccccaccaattattttcttattttaaagagaaacctgtaatggtgtcctgaggttacctctagctgttcaggactgatacacttatgaacaaggaaagacaatggaagtgattactaaatcaacatgttaccaaataattgaagatttaaaaaacatctatcatgagaaatgaatcatttttcaacaaaagggtattctttgtgttttctaagctaaaacattagaaacgtcaatttccagtagatgaggctatgttacagtttattccatttataaccctcactgtttttggctattttgttcaggctagaaacagtatttaaacatttcaattgttgtactgtttaaaatggctgcctatatatggaattctaccttgcaaagtaactatctgagtatatctgaaatttgccatcatttatcaactgcccaaaatacgtttttcaatatttcataagtatacaataaaacttcttaagatatcagaatccattttagaaactgaaataatgtagcattactaatattcactttaatagactggttggtcaatactctatgtttaattataattcatttggatccactttacatatgtgttatttaaaaagcaaatcatatcctatcatgtgcccttagccaatctcaagagcaagagaacaggactttcacaaatatgtaagcaatcttctttttatcatcttctgtgttcaaagttaatcctgcaattgtattaatttcccctatgagtagaaagctgaaagaaaaaaaagaataaaactttgtggtttacatattgcattatcaatctcttagtgtcagaaaggctgggtctttttgttgttcatcattctatctgtggtacctaaaatagtctcacgcatgcagtgagctctgagtaaacacttgttgcatgatcgatggtgccaactattggtgcattctgaaaaacatgccatggagaaggtatagcagaaaaagcctgcaccacgaaataggaactctgaagtctattctggtttttgctcttttctgaatgaccttggacaagttcgtgtcccttagagcctgaagttcctcatttacacaatgggaatgaaactacctgtcctgtccttcagcaggcatttagtggagcaaatggggagagctctgtaaacatccaaataaccaaaaagacaaaggaaaacagaatggctgaagagagtgcagatctctcgctttatctcagcagtccatgtgcctctgtgtttacactcagcttttaattatttgcattaatgaagggcagccgaggcatagataatcccaagtacttatgtttggctttggaattaaactgaatgtgctctgtgtaacattttgagagtgtattctcacaaagtcatgaaatcatgctatgaagacccagttctctgacactggctttggggtaaacttgtaacaatctcttaatctccccgggcattaaggatccttattacacccacagccctctgtcagttaagaggcagacatcataaacacggcacatcagcctttggcaaaatttaatttcgcggtgaggattcagtacaagactctttaggaaaccgggacaatcattttgtttacttgtttgctttatcaggcagaaattagttgaggctatcatcggggaactgaggcagtgggtgttcgtagttctgatttatcactgcctggcatattatatgtaaatgcggtatacccattcatatattatgatggttcacttttgaataaatgaatatatcactccatgaagatgttgagtcatattttgagtctttaaaataagtacagtactcgtagcttcccttctacttagtgatttatcattgatgaaacatgggtttctgaaatagtgctgaaataatttatttgttttctagcctatgcatttgttgatttgattagtaattttatcctccctctgcagcaattggctggtaaaactattccttgtaacttcagaaagtaaagtattactcctttctcttccttatgcctccaggctactataattccaacctgtcctacttcgctatggacatatttttaagtgtcaaaatgttctgcatatttacactggagtgtatatctagaatgcaggagttatttaaggcccttaaaaatgcagcagtgatgaggagaaaagagtgacaaaaagtgagagtgaggcccagcccactggagaggcatatcccataatccgctcattcatatggaaattcattatttttcaccctccaggtgcccattttagtcagaaatcatttgtatggctatggaatcacttcgtcactgggcttgactatgccaaggtcacaaagttaaattagtaccacagtcgagaggtaactcaagggcaatttgttccactttgcttgctcttctctactgagctggcctccaagagtcatttactcgagtttgtctctcctgtccccaaaagtggtagtgacctgctttgtgacatcccacaaagagcctccggctctagcaatgggagggtagagtgaacagaactgggtttagaacctcactctggcacttgccagtttctatatcagggttattatatttacctcataattttttgtaaggattaaatgggatgagccatgagaaataccttagagccttacatacattaaactttatttttaaggagcttaatgtgactgactatgccattaatgtgacatagcacctctgcttttgctatcattgtaacaacaagggctttataaggcagaggtgctccagcatggtctgttgcactggatggagatgggggctgcttcttgattgttgtgtaatctattgcgtatatgctgctttctggttgaagggtgagaacaggtttgaccatgcacttggttgcatcctctctggcttgctgatattgtttggctgtgtccccacccaggtctcatcttgaatttttatgtgttgtgggagggacctagtgggaggtaattgaatcatggagacaggtcttttccatgctgttctcctgatagtgaataagtctcatgacatctgatggttctaaaaaggggagtttccctgcacaagcactgtctttgcctgaggccatccatgtaagacatgacttgctcctccttgccttctgccatgattgtgaggcctcccaagccatgtgcaatgtaagtccattaaacctctttcttttgtatattgcccagtctcaggtatatctttatcagtagtgtgaaaatggactaatatacttggtgaatgcctcagggggaggtctgcctgcttatctgacctagagccactcccaagttaccaacttggttggggaggcaacatgacttcctggattgagcactggagcaacaatcatgagacctgggcttcaggccaccaagttccagcactaacgatgagtgaccttggcaaactactttccatttcttcttcccattagaggaaaataattgatcttttggtcataccttacaaagatgttgtgaagatgaatgtagaatatctgaaggagcatcagagggaaatgccaaagtgtacataattagttttacaatctataattaagtatatggatagagatgaggtatccatgtgtgaattatacatttaaaaactaggcttgcttttttttttcctttctaacagtagtgaagagcccaattacacctggtgttatattagtagagacgaagacccagaaaacttcattgtataagaagttcttaatgcatcaggagaatatgataccaaaactgttagtgaaatgattaaaggtaggacagacagtacaccactaaaggcaaaaggtgataggttgttcttgattcacaaagaaaagaaatcaagtcaaaggtagttagatatgaaagattcagggtcttaacccagttctggatgtgggcatattacagtacagtagtaaccagtccactaaatactaaaacacactgagaaaccatctcttcaagccatcctctaagtccacatacctcagccaaaggagatgtctgggagacagaatgtgagcagctgccaagctgcaactcgaacccattcagccagcccagctggggaccatcccttgggtcccttcaggcatcaggagacttctcctgcttttgtagcctttccccaccttattcttctgtatagaatccactgcagaatggcaggggttgatacacatgaagtatttttaccacctttctagtgcttttccagatactcaacacaagcaatttgagtaagctagagctccaaaatttagagtcaatagagaaacatacattattcagttttttgaaagcagatttgaagcacgtacgccatccttccaggctgattatcttcacttcttgggtcagcactcatgccatgacctggcctttcctgctgttttctctctttccacccttcacaatcgagagaaggtctccttgggccatcatgatcatgaggttggtaatgcacttttctgtctgtgccacaggccacctgcttgtttcctcctgaaacttctcttctcacagctcacagcttcttgacttccaaattgataggtcacagttttaacacactgggttcataaagcaaataaagagcattttttaattttctctagctgtttgaatctttctcatgagcctctacttccctgggctggggccaagaaggtgggggagatttaaacttagcagtcttccagtttatttcagtccagatcatctctactgggtaagtagtctgtcggtgtagagtttcactctaacagacctgttcctccctccctctctcttcctccttccccacttggttgctggctataaggaaagcttctcattctcctgatgtcatgatggggaagggtcccatgtctcatataagggcttgggctcgtgtcccctgcactacctctttggtccttgctgtcctctggctggtatctgctgaaacctggtggattcagccttaactaaggagtcttgcctgtgtgcctgttaaagtcctgcctgttgtagctccaggtgtgtttgcttagccaggccatgttcctgggagcccagcaccttctttggctgaatggagctcttgacagtatattccactcaccaaggtctccagctctcactagtaaatttcacctaccaaggtctccaggtcttactagtatatttcacccaccaaggtcactatgtgactctgagaggcttgtccatcagcccttagattcaaggtcacttagcccccaccaaaaggagccccctgaaagctcctcagctttttataattgtccctttttcaatagggaacagaaatttctgatctcttctgtgctgcacgagagcccaggcaggctgaggagcactaaccccagcaccatcaggcccagactggctgagctgccttgggtactcactgaggtctctgcaaaatgcagccctggctctcaccagactgtccaaatgggagtggacaaaaccacctcaactcagattttctgtcaacattctcatcgtgttcatggctcctctctcagtcagggatgagggtcacagtgtctttctaggcttctcttgaaagtgcacgtctcctagaaatcccaaccaccaataatccatccatgactgactccacaattctactctttctcttcccctttgtttagcaattcttgcttattactttttttactagaatcatcgtatccccctaaccttcagatatacattgatcattagaatcttttgaatcattcttccaacaagtagttattgaggtgagctttattctttgtagtggtaatttttaaagttaataaaagcttctacctttatagcacatacaatctagtgagtgacccaaatttgtttttatttccttttttaaaaattacttagtagattagttggttgatgtatttaagcaaaattctttggataccaactatgtacaaaatactttaaaagacaatatgtgaatgtgtttgggagatgattcagtgatgagtaaacactgtccctctcttaaaaagcatatatctatgacacaagacataaataagtgctgtaatggctgtaccattcaactcctatgaagatgtagaagaaagaacaattcattctgacttgaaatatttcagaagaatttgcagagaatacagaattttatatgaacctttgaagtaatgcaaaaggccaagacaaagttgagttatattttagacttgagaaatagaattacagacatgaataaggcaggaaagtgcatgggaaggcgtaagaaagggtattgggagcaagtgccctgtgctgcccaaagcagagagtgatttgatgagtggaagaagagatgaagttgaaaatgtcagatatgaaggctttggatatcatattgagtttaggctttctttaaacagtggttcttgagaaggagagtggcatgatctggcctgttatttaaaatacagcttaaggaataatgagtttgaagcaggaaagatacttacttgtctctattactctattgtagtaattcaggcagtaattatgagaagctgagatacagaggtaggtgtcgaaatgaaaatgagaggtcaggcataagagacagcagtaggttcgattgacaatataggatgcgatagtttaataagcagctgaataagatgtccaagagttttccactaggatgttggggagttaggtgacactggggcagggagagattatgagacaatctactacatctgaatacccactttgtgtaatatcttatactgacaattctagggttgttcaccctttatctctgcacacagggatagtgacatcagaactcacactcccacatcttaatcttaaacagtgctttctatataacatcatctccctacttcttttctgcttttttccgataggctcacaaaacagcccaagtgaatgttgtgggacagtaatacaaaagaataaaggatctgtgaatgagtccagttaaccatgtaaagcaacagtgcgtgatgcccagatgatcctccatgagtatttgctgattgaataaattcaaacaattccaatggatcttaggagttatatggagcttcctgcataaccctgaagagtattgcacaggatgaaaaaaaattgatcttgttggagatatattttccttacttacattttcactatttttcatcatatatctgggccctaccctgaataccctgtttcctctgttacaatgagtgaaacatgcatgatctttcccaaggccaacacctctatttcctggtagatcccctttctcctagcagaagcttttacctgtaagaatttcacctctcacttctgaatccacagtttttcctctatactagatcactttgattaagtatcaaagtataccagatcactttgattaagatggagctataaaagctcccatcttttaatgaacaaacttcccaatctgctccagtttgaggttcagccagcacccatttctctgtgccataacagggtttagacccaccatctgaatttcctgtgattccattttctcctgaacccacccaaatcaaaccgtctacctccctgtcctctgaaattgcccttgtcaagatctcctcaacctcaactttgtgggaagagggtacaataatcaattatctgtcctcattctcatcagtctcttaataacttttcatatagtggattcctctctcatttttgatacattttccttactgagcttctgtgaagccctggaatcctgatattactgcaacttcccagccaggcactctcagtctactgtaataaaccatttccccttttcctgtattttaagtcatattttctcaaccagagctccccagaacatgagattgtaatgccggaaggattccactcatgttcttctcccccctatgcatctacagtgtttagataacatacttgggatgggacaaagagtcacttaggtcattttctatgattcagatcaagaactccagctgagaaagaatgctctaaatgttgatgtcacctaaaattcagtccttggcccttttctcatctctaaatatccttatgacttagatgagcttacgctgacgacatccaaaacctctatttccaacctcaactcttcttttaattctagagacttttgaaatttctacttgaacttattctacgatcttgtggctcaaaatgtgttactaaaaccaacattgtgagcacctaggaagttactggaaatgcagaatgtcaagctctaccccaaaactgagtcagaatctccattttaacaagaactccaggaaattcacatgcacatacacataataggtttaagaaacattaaagtaaaacatctcaatcttattatctcctaagcagactatttattcttgtttctctttaatgttctaagagactcttggtcaaatttcccttctatcagtctgaagccctttcatagcttactgcttatttaggccttatgtaagacaagttgtaacttttgagtaaaagagatttaccataaaaaaaaaaaggagcatacatttcagagccccttactgtacatgccccttccaagctgctgggagaggtcccaccaatgtgttcacactatcacctgctttgcataatttgccaaaatcatttatgcaaattaagaccactttctcttatcctttccattactgtcacacttctgggtgacaagatggcactggagtgaacgtgggcattttggtgattgggccacagggaaattaagctgagaatgtattcagttttagtttaaaggggtgtatttatgaagttcatagatcattcttcatatagccttcccagtataggaatggcttccaagaatagtctggtggcttcctgtgccctctcccccagcatcctgatacagtgatgcagggtcagggctcactatgatgcaaaggtgtctatgtgcccagcaataagtttccatgagtaggggaggaggataatgttggaaggatatggagctggaagctagtctttcaaacgtttaaccatcaaaccacatgattttctacggaaattatgtgacatggaatttatcagaattcggctgggcacaatggttcacgcctgtaatcccaccagtttgggaggctgaggcaggtggatcatgaggtcaggagttcaagattagcctggccaagatggtgaaaccccgtctctactaaaaatacaaaaagtagctgggcgtggtggtgggcgcctgtaatcccagctactcaggaggctgaggcagagaattgcttgaacccagaaggcagaggttgaagtgagccgagatcacgccactgcactccaggctgggcgacagagcaagactctctctgtctcaaaataattaattaattaattcattcattcattagaactcctgtgcttgtataagttctgtaaccatacacacagtaaatatatgtgtgtgagaagacacattttatgcattccaactataaactttttcaaagtttgatcaaccatgccaaagtaaaaacagaattatctttatatccaaatgatatgattatcattttatgttaagacaatcaaagtctacgtaaccaaaaaaagtatgaaaaagcattacagagagatattgggcagtgcatttatgaaggaagattatgtatgcatattttgttatgtttgtagttttatcagctttaaatatctgtcattttgtgatttttttcttatactaaataatttctcattttaatttttgtatgtataattatttatcccttaccttgaagcctcaggtaacgaaggacctggttctgtcctgggttattgttctaaaggaagtcctaacactatatttatgtgcctttctcaaaaagataatttttatattatggtgccaaatagaactttaatgctaccaagttcctacaaggaatccttatctaaaaattgttccagctccttaccaaaggaaaggaggcttattcatcaaacccacttcaagtgaggtgctagatttgattgaatgtcatcactgccaatcctttctttcctctgatgcacatgcccaattacaacctaaattccctctatctccccaaaagaggatcctgtaggatatataaaaaatttaactcctatcaaaggtcaagtactgtgttgttagtgagtaagtaaagaataaagtattgagtagaaaatacagagcagcacaccgcttttcatgccttgaagtggcaattgaacaatgagaacacttggacacaggaaggggaacatcacacactcggacctgttgtggggtggggggaggggagagggatagcattaggagatataccaaatgtaaatgacgagttgatgggtgcagcacaccaacatggcacatgtatacatatgtaacaaacctgcacattgtgcacatgtaccctagatcttaaagtataataaaaaatatatatatatttatatatatatattctttatatatatattctttatatatatatctgtatatatatatataaatatatatatatataaagaaattcccactcattgcttacattagcagaaccaaaaatgaggaccaacccacagatgtgatcgccacactttatgcagtaactcagattaggagtcattcttatccttcttttcttatcttcacatcctatgcccagttcatcctcgattcaagacaactctaccttccaaatgtatcatgaagcagaccattaccaccattcctgtctaagccatcctcattactcatctgttgcattagcctccagcttccatgctcgccaccccgctggtgctttcctcaccacatccacagtgatctttctaaaaaataaatcagatcaggccatcctatctaaaaatatctgggactttccttcaagtttagcatgaacctcaaactccatgcatggcctttaccgcctcacatgatataccctgcctttgcaccccacctctccaacttgcctcttttacaatcatccacccacacttactttcaaggtgttcctccaggaaactcagatattcctgtctcagggttttaccaccaggaaacagctattcctgcctcagggttttacagttgccattccttctgcccccgcatctcctctgtcttcccattcacataatccagatttgggctccaacattctcttctccattagaagatgcccttgaacaccctacgtaaatccaggccccacctcacacacacatacacacacacacatacacacacacacacacacacagtcacattggcattctctgcctccttggtgtacttcattgtttttcacagcacttgtgtccatcacaaattgcatttctttttctcgatgcccttcccatgaaaccataaactccaataaggcatggactttgctttgcatccccagtgcctagaactgggcctaacatcagttctgtactcattaaatatttgttgagaaatggaaaggatccttaaaggctttaaaaccttttggtattgtctatgacatactgataaaaggaacaatggaatttttagtagagagtaaattatttttttgaatttagaacttagattttaactatgaaaggaaaattcaagaccagtgctgacgccttctcactttctgcccagagttctttccattacaccatgcatgttgtcttcctaaatgatacgtttcgtaagaacatgcttattcaagattccacactgcgcaatcatctatgataacacgtctagaataaaaattacaaaattaacaccacatcaccctgactattgacatgcctaagcaatttgcttaaaaataaacctgtgaaaggtgaaggaaagagatataagcgtatacttattaattaatcaattaattatatatgtattccttaatttaaaaaatatttttaaaattttaatcagttcatagtaaattcattcattttttaaagagaatagtcattataactaattgtcaagttttccttcaatctgtctataaattcaggatggtgcctcttgatagcagtcataacaatgacaaagtaaatcaatagcacttatttttggatctcaataaatgcaactaattctgtatctaatcctagactaaccattttctgttccttggtaatcagaaaggtctaccactcagatctcccttcaagatgtccctggtcatctattatcaaggagtactgtaagctgatcgtctcatgcaagatttgcctcatcttttaaggcaaagcctcactcactccagggagtccccagccaatgactgagcatgactgggatgttaacattagccacttctgcccaacacagaactcctccagtggacaattcctgctttagagttccctgttcatttgacctaaactttatgagatctgcatttccatctgaaggcttttcgtcctcaattctgcttccttcctcttttaccttcacaggcattaactcctaataaacctcccgcactcctaactttgcctcagcttccaagaggaccaaaattacatcttcatggcacatggtctcaggatctcttgaaactgtgacccaggccatggtcactcatatttggctcagaataaacctcttaaaaatgacacatcttctaaattattttattcatccatttaggggaaaggtattttatcaaatgactttttacataatgtgtaaccatgttagcatgtataatcatgactacacaaaaaaaacagtacaaaagacactcattgccaagttatgtcaaagacctaagtggcttcacaatctatccacctttttcttctgtttggcttatttgaatgaccgtgcttttgtatccttccatctggggcagtggcatggtgagggctgtgttgtgatggatggggttgtcagaaacccactgagtatttagatactgcatgagtgcattacatttacaaacagctgcatgacaaggaagtgtgattgcctcctcttttatgttcttctgcatgttaaggaaaccagctactgactggagagtcacttgatttttaaaatgatatattttcctttccttttcctcccaccagttttgtgcttcttgattatagtggaagcaaactcccaatgtttttttccacaaaagttttagtctaaggatgaaatatatgtttttcagctagtcttggataatccagattagcaaagacaacacaattagaatcaagtctataccataaacaacaacaaaaaaccattgacgagaagagacatagagaatgaatacttattataaaaaacactgtaccccatttcttgctcacggattaaagaaatcagccgttctctcttatgaggcccattttttattatgtgtgtgtggcttcaggggctcaatgtatttaaatgagagaacaggacaagcatgggagtccccaggcattttcctctacttgcaatataaagaacatctaatcatagacatttcctttaagaaattgtttctactcagtacccgtgtcttgaagaggataggttttttatccttgagatatacatttcttgacccaatactttacacttccgacacaacgaagaaagcagttaccatactgttaactcctttggtattctctatttggggaggcagggatgtaagtaaggttctctggatttataaatactgtagtggaaatgtgtgctgcgttggttggttagagagtagtctcttcctaataggccccagttttcttttgtatatggccttttcaccattgcatatggtccccttgggaaggcagttcaggtgctcactagagaaggtaaaagagaccaggttctttccttcctgagtaagcaggtgaccaaaaggaattctcttctgaggcttcaaaaataggtaagtaaagccttgacagaggcaatggtggcagatttcttttaaatccctgtggtatgggggtccaaaacaagttaaagtatggaaatggatttctgtttcctatttttatgtacacatacaagcacacacacacacacacacacacacacacacacacacacacgtatacacaggcaaaacccagtgaggtatctgttccagtcctcaaaaattgaacatttacagtgaacttgtgtgaaaaaatagtggcatgacagatgtttttatgtaaaaaagaagctatatccagtggcttcccataaattcctattgttttatttaagattctcagcacttttgaaatggtttagcatgctgtcttcattctcacatatttgaaactcttaagtctgtgtgggagacaggtctcccaggatgagaccagatgagaacagaccacctcttatcctacttcccttgatgatttgagattttttttttgagagcctacatgacaacgttttcctttgaaaaaacttgtttatagccaagaacattctgttatatccttcaggcattcttgacaaacaatagtttcagatttagatgcttaaacataaaaacttagtgccgagattgtattgacttgagaatagagataagtaagcacaataaacatctcttcttcatgacatcagaaagttgcttaaagtgttagaattattttaaaagaatgaaaatatgatatttttctgggtaatttaatacaaggaaactatgtactttataattttattactttcctagatttttatttttaaaatgaggaaataaaaattaatgataagtgccctttgttttccaagtagtataaaactaaactaaacttaaataatacagaaggatttattagattggggtgtgtgtgtgcacgtgtgtgtcacacatgagtcaggcttcaggcatagtttgattcttgggactaaattattactggggttctgtctctgcctctttgaatttgtcttggttttttttcctccttctatggtatgttctttaggatagcttcccacataatagaaaaaaatgacttcagcagtcccaggtgtgactgtcatacccacatatcatctataggaagttaacttacctttgtcctccaactccaagaagaagacctaggattcggtctgactggtctggattagctcacatgcccaccggaaaccaatcactgtagccagattgctgggatgtgctgattgacttgtgtaggtcatgtgtcccatctctggagcaataatggcctcagcttctctaaaaccacatgaatccctaaaagaagctattgggaagtggaaaatgcagaaaagtacacagctcaggcaaccaacaagtgtccagtcacctccattgtatttccactgtaaattaggaacaagaactacagctagatgtgtggttcaaggttcacccatgccatccatcactttgtgcaacagctttggtgtgtgaagcaacagaaagaagtcatataatggccagggaaaactattcattgtggcttgtccctgaatgtctcagaatgttggcctcatgagtgccctagaagtattagaccaagaaacactaatcctcactaacaggacttatgagactctgatgtagaactcaaaaagcctgttgatccaataaaataaaaacatctttgttttcaaagtgactagatacttgccagctatgagaaaagccacattattatcagaaggatgtttactatacttggaaccaaaagaggcatggttagttttatatttcaaatatttatggcatcaggtcattatagtcagatgtcctcaccttgtctacaagatgtgagtggatgagtccttgatcaggcacaggcttagacaggcactgaccatgtttgcctcattgtctcccccattcctaggctttatggctgctaataccttttcctgaatgactcttttattctctagataaacttaaaccttaaattaagtctttttgtctaggatttactctatctctttatattcatagtatgtgtccatttaaagtttaattctatacagtcaattttatctaaaaaaattgattttttctcctatataccatgtaaatgtcatactttacaggtttttatagaattaaatactttaatacatgtaaatggaagtaatacctgttgggtatctactatagccaactggtttactggtcataacacatgccctatgttatcttatttatactttgcaatagccatgtgattttacagaaaaagatactaatgttcaaaaaagtctagcagctttctcaaggtccaacggttagtaaatgatgaggtgggattcaactccatctttgtctgattccagcgtcagaggtctatgcatgtaaacactgtggggaaatattaagatcaagtttgtgtttctcacaattccttattaaactgctgaaaagcaaaattcttcatgtctaaagacaatggcaattcttaattcattatttcaaatttaattgaaaagtattaatttagtttattttttctatgcatagagtaaacaagtccctataaagcagaatgtacagtaatgaccaagaaaccatcatgaaaacagaaaagagagaagtgtttcaagaaaaccaagggtacaatctttatgacttgccacacatgaaaaaggaagggaccaaagagatggaagagctaaagtaaatagcagaatatctacctagggtcttgtctctcttaggtgacctccatagtgtcggggagctagctatagtcatgcatcacttaatgacagggatacatcctaagaaatgtgttgttaggcaatttcatcattatgcagtcattgagtgttcttacacaaacccagatggtagtgcctactacatgcttaggctatatggtatagtctgtttctcctaggctacaaacctgtacagtatgttactgtactgaatactataggcagttgtaacacaatggtaagtatttgtgcatctaaacatattcaaacaggaaaagtacagtaaaaatttggttttataattttatgggactgccattgtatatgcagtccattgttgacagacatcattctgcagcatatgactgtatttgaatgtgttgctctctggtttaaaacctagaaatcacctgtgaattacctctggcactataaaaaataatttccaggttctagtggaaggattaaatcagtcttttgtttgttggtgtgttggcagggaggggacttatttatgaaaagctctcgatgttactttgttgtgaagttatgcagccagggctaactactggggtagagaataatgtccacccttcttagcaaacacacacaaatgcctgcaatctgaacctcctccacctatcgctctggccacatccagacatatggaggaactcaaaattccccaaataagtcggactcttgtggcctgggccttggctcatgctgtctgtagacctggaattcctgcctgctgcctgtctgccaggtgaacttatgcaaaaaacagctcagcagtccttgtttatttcctcagaagcagatgtaactgttaccttctttataagatcaatgctatttttgcaaacatccaccatcctgttcttatttgtccatgtgtcagactccctctactaatgaagctctttgtgcccagaactgccacaatttgcattaattaaatgaatgattgcaggtatcctgcttggggatgggggcgagagaatggtatcactgttgttagaaacactaaacgtaataaatggcaaggaagtgaataattaactacttaattgcaattaaaagtttctggtgcctggctataaatttgcttaacatgtggaggggtagattttgattggacatgatcagctagtaccaggtggacaatcaggcagggatgcccagcaaatctctgtaaatggggagtgagctcagttgtagaagatattccaatgagagactagccggaagggaagaggcattaggattgtgaaaatcctttaaaattgttacctactttacagagaagaacagatggtcttgctctgctgcgccaatcacaaaaccgccacgtaaggataattaaagtgggggacaggtctggcatccagttcttcagtcaacattctcctccccaaatcttagactaaattgtaagacacacaggcgtccacatgaagcgtctgcacaggcttccttcaagtgctgaggaacagtgtagtctttgctcagcttttgtctgggagcatggaagttaattatatttttcatgttaatattttggagtttcagtatgaccctctgcgaaatgaggttatgaatatgtaacctacctatcttaaaggattattacatgcattaatatatgccaaagagctttgtagactgcaaagtgatgtaaaaattagaagtgattttttcccaccgtagcaagacctttatcctgtgtcaattcaattacattgccaaatatcactgatttatgctcctttattcatgatctatacacccatatttataaatcactatgataggtattcacaaaaataattgaataatttattgcaaatcaaagttaatgctttttcttatggccttctatttagacagagtatatgcatttttcttctgactaaagcttgagaaattcatccaaactttatggtggcctgatttatgcaggtgatggaaagtagcaagagtagggcaaccatatttaaaccacccacaccagtggtatgccagacacctgtggaaattccatgctgggctttgagggctggggactctaagattccagtgtgggctgggaaggaagaacacctgaaccagcagctattgttcccctctcttgctcactgacagctgcaaggtacactttcaggaccaccaggcaatggcatgctggtggcagaggaggtgacactcacctcataggaagttccttataaaagcaggtggacatgtcatctcaggctcatcaaatctacctgccatcatagatagaccacagccaggccaaccatgccttctagtatggaccttgttattttgagtttgcttttaaattagaaaaggggatttatttgacattgttttctctattatcctttatatttatttaaaatacccacccacaaacaatacattccctgctattctgttccaattattctctgaagaagattataagcaaaagagcagcttttccataacattcaaaaattgcctcttacatgataggcaatgagctagatttctgcaggaaggatatttcatttaatgttcacaaaaatcttatgaggtagctaggtaacattgatcctcaccttacagaagctcagagagagtaagtaacttgtgccaagatacatagttagcaagtggaaagacagaaatttatacccagatctgtctgactccaaagaacacacctgttagcttagaacaggacagatattgaaagtatactatcggccaggtgcagtggctcatgcctgtaatcccagcactttgggaggccgaggcaggtggatcacgaggttaggaggtcgagaccatcctggctaacacggtgaaaccccgtctctactaaaaatacaaaaaaattagctgggtatggtggtgggtgcctgtagtcccagctactcggcaggctgaggcagtagaatggcgtgaacgtgggaggcggagctcgcagtgagcggagattgcaccactgcactccagcctccgcgacagagcaagactccgtcttaaaaacaaaaacaaagtatactatcttatgggtcaaattaaattaccaaaggtttaaaaactaaaaatatctctaactttgtggttaagttatatgaggtttatgtatccataacccaactgtggtgtagtatattaataacagtctttttttttttttttttgagaaagggtcttgctctgtcacccaggcttgcatgcagtggcatgaacatggctcactgtagcctccgatttccaggctccagtgatcctcttacctctggctcctgagtaactggcatgacaggtgtgcatcaccatgccaagctaatttttttttaacatttcttctagagacagaatcttgtcatattgcccaggctggtctcaaattcctggtctcaagcgatcctcccactgcagcctcccaaagtgctgggattacagacgtgagccactgcaccggcccaatatagaaatttttaagtatgatgcataagtgctggggtcttgtatattttttggtttgttttgaattttttaaatattcaatcggtctgatttcccaggaaatagactctgaaatggacattgtctggaggactactgaggtgcgttctcagaaatagcacctgtaaggaaggtagggacgcagggttagcagagatctgagcggtgatatatcaggttggcaaaaacaacaattacttttgtaccaacctatgattcacagtagataataccttgtgccatcctcggtgaactcttcagctggcattaaccttcagagtaattcatcaaggcaaggatgctgggcctttgcactctcttatagagtattggatgtgagaagggggcataactcagggatacactactttcttccacagagggcaattcttggaaaaggaccccattgagagctatgtggtgcagtagagatagcaagagtgctttgatcatgacaaggccatgggaggctcattgcagcatgcactgtagtcccctgtgtcctcagggtccacttgaatcatctaatatgttcacctaatatggaaccagctccaggatgctggatgggctcatttcctggggtaactcataaaaggaaggtcagtgaggtaagcggcaggctccatggctgcactgattctgaggtcacaccaaaagctaattatatgccaatcttaaatcctctcacttccgctcttctaggtgatttacctggtagaatgacccacctgtgcatctctgatgtctaggactcctccttaggccatggtgctacacttgaagatgtacccctaacattgggcctaactacaagatagtatgtccccctatcccctggtctagctaggctggtctctgttgtggtttgcatttctttatttgactcgattgctagttttactccctttctgagtccaaacataccaagattcaaattcagtgagaaagcttaacacactcagtaatatttctgaagtgtctaccctagactaggtccctcactgatgaccacaccataatctttgggagctgtgaatatgttattttgagtggctaaaaagactttgcagatgtaataaaggttagggaccctaaaataggcagatagtggagtcatttttctcttctcatttcctttaatgcttcttctgtgcctttgctaagatgtttatcactttctaccttgaattataggcactgaggtatcagttaccttctctaataggctgtaagaaacttgaaggaagaatctacttctgccttatttgtgctgcagtgaattacactgggtagacatttttaaaaaactgtagattgagcttatgatatcatgcaatcttcgaaatagatgagtaagagatttgatacgggctgctcaattccacccaatactgacattttgttctctcccactcttactggttgcataataaccaactatcgaatagcttcttagatcattacaatattaataaagttcattaattaaaatggcccaagtcaccaagatgaatattttataggccagtcatttcaaacatattagtaccatcattattatatattgatgttatattgataatataacatcattatattatatcattacattgataatatatcatattatattgataatataatataatgatgtattatatattatcattgaataatttatcaaaaatatctagaaaatagttaatccatgctatataaatttttttctattaacctaggtatatagattgttgaaaacattattttgagttagtgttgtgatttatcacataacacatgaatactaatttagctaataaatgtgtcatgtatctagtgaataaggctggaacacaaacaggacatttttgtaacattccataccaagtggtagctcttaagatatatgaaaaaaggagcaacagtgccttgtggtaaaggatgagtaacaggccagaaccagagaccttccagaaagagataattagagatcccagattgggactgacaagtttgaaagccatgctgttcaacccagacaggttgagaacagagaaaatcatatattccaatatccagactaatagcagcaaagaggtcatttgtcagaattaaaggggcagcacaaaatggcagaagagtagatttgaggattcactaaaaatgggaaccttggaaactgaggccatttctgacaagaatcatcatatgcttcccatacagaagtaagcaaagcctaggggacacatccagagtttgtagtgggaggtgaaagggtgcatctagcagacgtgagagacaataggacagaaaaatggccaactctttgcagcacagtaagtagatggatcctccaaagatgacctcatcctaatatttgggacttgtgaacatgttgccttgaatggtgtattagtccattctcgaactgctataaataaatatctgagactaggtatttataaagaaaagggatttaattggctcatggttccataggttgtacaggaagcatagcagcttctgcttctggggaggtgtcaggaaatttggaatcatgacagaaggtgaaggggaagcagacacatcttacatggccagagcagaagggaaagagagagagcaaggaggtgctacacacttttaaacaaccagatctcatgagaactcattcactatcatgagaatagcaggggtggtgttaaaccattcatgagaaaaacctcatgatctaatcacctcccaccaggccctacctccaacactggggattacaattcaacatgatatttggggtggggacacagattcaagcaatatcacatggcaaaaaataacttcgcaggtataataaagttcagggaccttaaataataatcctggattatctaggtgagctttatctaatagtcacatgatcctttaaaagcagagaatgtcttcagctgggaggagagattggcaagatgcagttgaaggggaggtcagatagattgaaagcatgagagggacttgacccatcattgctgactctgaaggtgaagaagacctagaaccagggaatgcaaaagcctctagaagcttagagtaaccccgggctaacagtcagcaaggaaacttggaactcagtcctacaagcacttggaactgaattgtagcactaaacgaaatgagcctggaggtggattcttctcaaagcctccaggagaaaaacacagccctgctgacatgttgattttagatttgtggaactctaagcacaattccagccaaaaccatctgttttcctacctgcagagctgtgagatagtaaatttgtgttgttttaaaccattgaaattatgtcagttgttatagcaggcatagaaaactaatatagatagtaaaagacatcttataattgacccattcatgacttaaaaaggattttgtctattagtctctcttttactttgtttccctgtttaaaatattaaaatgtcaagatactgggaaatttagtattatgctgttatcagaaatgggacaaaagtgacttcattatttctttggacatactctgtagaacccttacattatatgataggattttctaatgtcttctgccctaaaattcagtaaagaaaaatgtaatgcgtgatttgaaggctggtgtgtgtgtgtgtgtgtgcactttaatgtctctttacaaaaatgcttcaccaaacttttatactaaatcattttgaaaaataattatccactcagttatataaattttccttgctgatttttatttaattgtaaccaattttgcttccaattatagcaattggtattgtacaggaaagttataaagataagtaattgtttttagtgaatcgagcaacctcatatatatttttgagatttccttcctatacttttatgagacagtagcaactgaacataaacttttgtaatatgaaattaaaattagaattatttcaataagggagaacagcaattctggtgactatttagccccttgatgttgaatcatgccataccacacctgaatcgtcccacttgattagagcaaccattcaagatactcagtgccaatcctgtctcaataatctgtacttgctctgaatatccatttaaaaagtggataaaatgctaataatgctttagaaattgtgtttgtaactgcagtgttattaaatgatgccttagactagatgtattttggaaagaactttgagattattgaatgagaggttatagtaaatgaactttcacattccctttcccttcctaaagaaaaaatattcatttcatggatttagtctacctttgagattcttagtcttttctagggagttctagacatagagttgatactcagttaatttttcttttattctcaaaaacataggctttcaaatttaatttccttattttttcagattgtggtttaccagtaaaactattctggagtggtataagaaaaaccagaccgtgtggccatttatcttctttttgattcaaagtgattaagtgggttgaaggcaggggagatggactttcaaaacagagtgttagaaaatcatgttatttttatgtatttgtttaataaataagtttatgtatataaatcactaaagggaaaatcattctaatgatcttctatgtcattagaatatgactttatatatactcccagataacatacttgaatattggtcatgccgctttataaatgtataatcttgagtaattatttaaacttatcttggtctttaaaattaggattataagaatcaggctcaaaactgctctcagaggcaggctgcctttgaagcatctgctttcttagacaaattaggagtttcaaatgaggaaagaagaaaccaggtttttaaagagatagaaagtaggaaaatggtggataggaagcaggactaaattgcagctcctactcggagggacagagtagcatgtggagacacatcatgaacttttgctccaagaactactgcaggaacataccaggaaagccaagagaatccaccaaccctttgaaggaagcagattgctcctggacccggagagacagcccaaatactgtgagtgtccaaagtgtggaagtaggaaaaggggatcgttcccccttgaacacacaccctcactgggaaacctaaagatccagattacaggaaggacttgaccttacctggagatgagataattcagagagccaagcaaaatacaggagtagaggaagcagcaggaagagctctgtgggctctctcagtccccagggaagccatttctggtctcacaggggtccttggggagggctgccaggggaactgggaaaagaccacaggaagaaggaagcctccagctgaactctgtaacaattccaaacgattgcacagtttcttggacagaacgtgggggaggggttgaatacaaagtgcagatgtgggcaggtggggaggcatgaaacctgaaagctctgcttgctttctcagtcaggaggctggtagcctggggtgctgctcgcccactgcctggaaacgaactagatgcttttgaggtggagggtggggagtgcaatatgggagtgagactggccttttaagttgcatgggagtggggtgatgcctgtaactgccagctttcccccacttccctggcaacctgcattacacagcagaggcagccataatcttcctgggaacataactccattgacctgggaaccacacccccatccctcaaagcagctgcagcaagccctacccaaggagaatctgagctcagacacacctaactctgccccaacctgatggtctttctctacccaccctggtagctaaagacaaaagccatattttcttggaagttctagggccctgctcagcacctgatccaatttataatttccaagtagtaatttgccaattatgtgtcaggttttgtttgtttgtttttttgtttgtttgtttgtttgttttttgagacagagtctagctctgttgcccaggctggagtgcagtggaacgatctctgctcactgcaagctccacctcctgggttcatgccattctccttccccagcatcctgagtagctgggactacaggtgcctgccaccatgcccggctaattttgttgtatttttagtagaaacggggtttcaccgtgttaaccaggatggtcttgatctcctgacctcgtgatccgcccacctcggcctcccaaagtgctgagattataggcatgagccaccacgcctggccactatgggtcagtttttaatgatactcgctgttgcttcacaatgcagttggtacatgtctttatcaagttaccaggaaaacaatactaaggagttaccaaaggtcaaattctcatgcagcaggaaatgagatattattagctctttatgtgcaaggagtagctagtttattgagaaatcataatgtgttagggtataaaaataaaactatgttattatttgtcagtaagtgccccaaagtactctgttgaatctcacctttcacacttgctgggtgagcttcaataatagaatcatagctataatcttgactttcattcatttattaaaacagtcacttagagttcttaaaacccagaatctcataagcatttcataacccctctctccttctgccccaccctgagaagatggaatgaaaggggatttggtctggctctcacaagcttttccctcacatgtattgcccacatattggcaaaaatgaaagagatgaagtaaagcagctctaggaggcctccctgaatgaggaggcagttcctgtctggatggtctcgctgttgacctggctggtgcatggtttgacaaagatggatggggtattgtcaactagtcaaggctcattcttagctagtctccccagtattagtgcttccatgtgagatttagccacatcttctgcccaactcccactacaaccttaccttgcattcctctcaaatacagactgcagccaacaatctcatcagacatccactatcaacttgaggtccacaggcctgttcagactccaccttacatattagaaactggaaacccaagaatattcaagttgaaggttgtgtgagactcaccttggcctggcagaagccaccatgccatctctccccagtgttttcattccctactccaccagcacagaaattctggtgtcaatgcagatgtccagctagggaagaagtgtcaatttcctcttcttataggcacatctaactctaatgagttattcttttcaggttttcctttcttagatttggaaaaataaagtgctcccttccacaccctaacaaagtctgttctcctgacaaagcggtatctcttccctttccatgtcaccttgttagtctgagtgtgtatggggagtgagaatattgggacgagaaggatgtaaagccatgctgctgagacagtacttctctgcaaaaccggatggggcatagctggctcaaagctgtcagatctatgagagaagaatataggtctacctaacacctctgttctcagatataaattagggttatgggctgaattttgtagccccaaaactactatgttgaagccctaatctccagtagttcagaatttgactgtatttagagacaatatctttaaataggtaattaagttagaatgaggtcattggggtgggccctaatccaccatgattgatgcccttatgagaaaaggagattatgacacagacatgtgcagaaggaagaccatatgaagacagcagaagaagatggccagctacaagacaagttgagagttcctcagaagaaactagccctgtctactccttgattttggacttctagcctccaaaatagtgagaagataagtttctgttgtttaagcccctgagtctgtggtatttgttatggaagtcctaagagactcgcatagtcaggaaggcaagagcctgctgtacacataacatcccatgttcaaatgctccagaagacagtgttgccaagttgttgtacaggctcttacctgcagcaatggttttctgcccaagaaggcttaggttaacattggcgagattcatgacaaaatagcaggtaggaaagggttttcatattttctctggggaatatatagtttaaacttaccagagctcaagggatcaaactggattcaagaagactggaacttgggtgagatcttctgattggtctctattattatgtcacttggtttagaaaaaaatgatgttaaaagggttcagtcctcattttcagtcactgatttgtaaactatcctcccttttattcagttttactatctgtgtattcctcacaactgaggaaagtgattctaataagctataattttttacttctgaaccacttgcttggttcattcatgttggaaaagtaatcaataacaatcattttaaataaatcacgaggacttcccttattctttccttttaacaaagcaagttcaggaaaattaattcttctttgcttattcttttagtcaagtagggaattttatttttgtctaagcttcattgctacggatagtcacagtggcattcaaatacttgccccaagaggtttaattgggatgttaatagaatccatataaaagaagttacctgcaaaagtgtacatatgaacagttaagtttctctagcaagtatggtgtggaaaaatgactcattctgactgcgcaactattaagtcttttggataaagtgttctcagataattggcagataatttaggtcaagtatttcttgtctatatgtctaatcccatccccttcctgttttctctctccaaagctttcctcatgaactgactctatatctgtatccataaagttttaataattagttacatttttttaaattaaataatggtgattatggaagccatggtcagatgccattcagatctcctttcgagagaaatctgcattgaagaagtcagttagttgacagcctgcagctaccagtccttcaggacctatcacggcttactctccaaggccacgttctccccagtctgctcctagcaaatcactgatcacagcaagggcacaaaccagactatttctgcctaatgaggtcttcctttagcagaccatcttgcatcggtctttgttcagaggtacaaggtgatccaaacccttcaaacccaactctcctccttccttctctcctgtccaaggtgtcagacctatattgcgtactgaaaactctccctgcctattcctactctcctgtgccttatctttcacccattttcccaatttattctcttgcatttttggtgtctgcttcacaaaggactctgcccagtgtgacaatctctgtacagcctgcagaaaaaaaagtgtttttagagaaaggggtagagagatactcttcaccactactcttactgcagcaaaccattaccttctgggggaaacagaagggtgtaatttaatataagattccaaatctagggttttttttaaacatttaacactagaataattaatggaaaatagatgaagacagtctctcaaaataagcaagttaatcccacttttttcatttcgagtccatctttttattgcccacaacactctcaactcaattacatcttacttcaaactaaaaactaacatccattttcaataactatactttaataaacacatacccattacttcttgtgccttatatctccctgtacacaaagaacattataaatatattaagtaaacaaccacatgcatatgggttaattacttagcacaaaaactgcaagatcccttagagatgtcatctgtatgacaggattggtgtttacccaaggctaacagatatttagaataggaaggtaacaaatgcaatttaatcagtgaagagctctaatttacttgtatcaaacaatataattacataaggcaacataagcataaagtttcctatgataataatgattatgaaaaggaagaggaagagcacatcagtttttactgagtgcattttacataaattttctaattattaaccaatttaaagtgcaaactccatcacatgatcacatttgaattgttcaggacacaaattaaacttttctcattagaggaatatgtgtgttttcatttcaaccagcaaaaaacagaaggaaaacacaggaatgtgaagagttaaaaatgaaatgttcaatctgttatttggttagtcttcaggcttcagaacaaatcttcaagtcccctattacactattctcgtcccttcagggactgctctttctcccagcgttgtgtccaagtttgggagtgtcctgaggagccaagttgcctgagtggggattgtccctttcatccttgagtaatctgatgctatctttgactgtgtctgcctagataatccttccagacaatgttttgctgggtccttctatctactcaggattttacctgaaaacagatgtgttctcttgtattcccaagccctccaacccctctttctgaaacagttctacttccacatggctctacccaaaaatgagtgtaaaagcactcctttctctgaagcatcaaaagcactctgctggccattaattttccatatttcattcatctaattctaattcaccagtcaacattatcgttttcaaatttgtcagaaacccctgctctcttttttgatctttctctcaaatattttgtctgtgtccctaagctttcaacttcccttgaaggtttaggcttttggattggaaagccaaaagatagcaagctttctctgattgctgttctgtagattcttctcctggggcaacaagcacaatagcaaacatctgctttaaaaggaaaagaaaaaggggaaactaccaagagaggaagaaccatattattctgccacttcagcatatggctagacagtaaattaaagttttagagttgggaggaacattagaagtttccaaattcaacctcttttcctatcttctctgttatatgttcctgacagatggtcaaacagattccataatttcagtgacaaataattcagttcctcataagagagtgcattccttcaagaatcattagacttcttagaaagttcattcttatattgagtaagcatctgtttccattatgggtaacagaagctgacgggaataatattggccttggatctaaacagccagagatggttcagatagtctctagaagcttcagtttctttatctacaaaatggagcagatgatacctatctttcaaaattattgggaagattaagtgaaataaatatacataaatacctggtatactgtttgttgtagtagatgtttgctaaacattaaatctgtgcaccttaaaacatccagtaacagtccaaactcattcattcatttattcatacaatattgattgaccatttatcttattccaaatcctggaataaaccctggtagtatagcagagaataaaacaaatttataccttggcgtaaggaaagatagtgtatccagtataaacattgaattactaatgtgagaagttctgtcaagtaaaaattctacttagtataaagagagcacatgcaacaggaaacattaaaaacatctattttcaatctcacacatagacacagacagacagacagacagacacacacacacacacacacacacacacacaaaaccataacgtattctctccccttacagagtctttttatatcaagaataaacactccaaagtctttatctattcttcagatagcatggttatttgatggcttaatgtttcctattacaatgtggaatgttgaaaaatccttttttatgttaactttaaacttaataaagaatttatattattttaagttcttcatgttatttctgtctctttccatgtatacaataacaactgtaagtatgtatattacttttatagtttgcccattctacgtgctaatttttatttgctattatattttcttcttcaatgttgagaaggaaaataagttttaagagaaactacaatttatttccttttggaaacttatttttaaaattcattatatctagattgagtttctaagtttctcctcatcactagacctactgctgttgtgatgcaacaaaaagtgcttgggtatcatcctttataaggagacatctgcactaagtacctatagtctcatgcttactctgtctagctgccctaggctcctgctcacagaacacagcccccagagaccaggtctctccctccttctgcacacttcagtatttaagccatcagtctgattttatctcacattgttcattttcttctggttttaagaagaatttgcacttggagattacttgtacattttgcatttcaggcctggaattgaccccatcagaagctcccaaacaatgaatttgcactctttaccccattaatatacatttaacaaccaaagttgtactgatgtatcaggttttaaaacctcagtagatgatgtgcttgttcccaaaatactctttccctttctttgtaaaataaatctccttggagttcactgtgcctttatgttagaagaacgcattttaaagaatgttcagaaaatcctacttagcccagaattcctatccccttatctgaatttcctcttctttatctctttgaccctggaattcaataaatttgaatattaattttgagattcaatcatcgagtcagatgagtttcccaataaagaaattgacaaagtctcagttggacctgaacgagccctgagaaaaattacatcatatctcagtttcctcagctgtaccaagggaagttcactggcattgggctccttggccaccgcactgaaaataaataaataaataaataaataaataaataaataaataaataaaattgcacatgttaaggaaaggaggtaagagggaaagaagactccttcaccttactgagtgtctttaagttcggctccgttcttgacccaccccacccatctgaattagcttgcttcagaagagccagtgggactgcgcactaatcacagggtgtttcccagggtctcaggcaccagtcccggagtttttcccagcagggctgtgcaccaatcatagcgcctcacccagaaatgccatgcaccatcatgaggtttctcccaaccgggccatgcaccaattacagggcttcttacaacggggccccgtgcccctggaccagtcctgactacacaccttcctcagcagctaccatgccagggccagagggtaacgaggcaggcacttgtccttgaaaaaaggaagaaatatcaccctccctctgtgaatacatgtgattgttctcactgtctcccttgaaagctttattctcggaagtacacgctactatgctacggcagatgtacaatctgggaagttttccaaattcgtcactggaaagcatggagtattcagcattagcgcctccgtggaagtttctgtctctgcctcagtcagtctggctggcagcactgaagagtagacggttgtccagaggctgggtaagtgggagctggaatcctgtgacagaggcactcccagccagcttctcaatttgcagagctgttaaggttttccctgacagctgcacacatgccacatgagcaaaacggtccactgatgaggcaccagcttgagattttctgaataagctaacctctgggaaagtgtaaagtcatgagcttcaccgcgcagtatctacaagggaaggatgcaagagcaattgtcattctcattgcttccagcacaggtggaaggagacactgcggatggtaacttccttaccaatttccattatgtgccctgatactttagatcctgagcagaagccaaggaataaattatgaaaacaacgatttgttcccctaatataatgcaggttcgtatcagggctataatccctgccatctaaaacacgggatcaagttgtccgactctcagaggccattaaaaacattcacgtattttagagtttttcacagtttcaagtacgtagttcagtgtttgtcttatgagaagttcttgaagctaagtagcagctggccttctttatcttgcattacccattatctcctacattgtagaagtgctttcagccctgaagcaggtgttattgtagagaggtgcactgaaagaaagcttggaggatcttaaatgcctgtgctctagaaggtaacccgagaaagaggagagatgcggggacattccaccgtgtctgatcctgacgctgttccaactgtacggcttagacaacaagcagagcgggggatgttgaggctgagcgctagggtggctgccatctgggtggacttgcctgagttaaaggaaatggaggattcttgaatattttcaagtagatttccagttgtctcaagattcaagaatttttaacataactacaatgttgttgctattggtttgtggattttgttttttaatccaagtgagaaaaaaatttggaatatttgagaatgttaaattctaaaatcgttaataaggcctattaagtcctgcatgttctgggttctgtcttcctctgtcacctcatctcaggccactcacctgtacaaaaggaaagaaactactttgttttcattttgtttctaacaagatttatcaaggcaggtttcatggaagtgaggaggtatgagctggcacattgtgtcagttagctatttaatgtggctgcaaaacaagccacattaaaacatagtagcctgaagtatcaataatagccattattattgctcatgaatcgaagagcaagctaataggtcttctggactctctttaaattattcatgtgtccatggccagcttcaggttaggcaggcagctttgctgatctttgagcatttttatgtatttggagatagcactgctgttagctggcctataatgatcttggcttttctcggcataatcttccagcaggccatcctgggctttttgtccagtcatggcaggttccgagagagaaggatctcaaggccacttgaagcctagtcttgagctggcggacttcacatttctcattctgttggccagagaaaatgaagaagccagcccagattcaggagctggagaaatgcactcagcctcttgaaggaaggatcttcaaagttgtattgtaaagggcatagataagggtccatttttataatcaaattaccacaaacttcaaagataagtagaagcacaactggcaaagataatgtgtaaatatgcatccaggtataagaagcaatttgagaaaagcacaacacaggttctataaagggcaaagagaattgctgccagaacaaagattttgtgtgtgcaggcctagaagaacactcaagatttatgagaaagaggactagaaataacacctgggaggaccttccattccacactaaagaatctatgatcagttgaagcaaccaagaattatagcagttctcttgtgcagcattgatcactgatccccatttcttattctggaaactgcccccttctgtgcattcaatgataactactctttctttgtgtacttattatttctctaatgtttattcttcactgttttagttctctgtctccatcctctgttaatttgaggccactcgacattctctgcttagccttttgttgttcaaaaatacctcctcaacaatttcatccacttcattaattttcactaatgtcatttgatggctgtcagatctatagccctcccagattctggagagctgtgatcttgtttatgtaactgcatcctggacatacatctgcagttctaacttaacttgtttcaaagacaatctccttattttgccttctatgctcctcattctcctgtgtattctcctagttaaagaccactgttatccattcaaatacacaagtcaggaagtcaggaaacacctgaacatcctctctttccctcatttcttacattgagtctgcaggtcctgagtcagttatatttcctaatatgttatcagtatctgaatgctctatttatgagctgtggctgtggctcattgggtgcttcaaattgtgtaggaaggacagagataatttgcctcacttaattttaattggaagatggttttactgatgtcttaatgatatcttgatcaagtcatatataagtaaaaaattattttttgaagcattccataatttgcttctaataacctaagattatacacctcattacaagaggcaagtgtgttatcctgaaagactggcaagagcatgcctttcaatgtaacttttgacctttttatgcactagacccagaaatcttgttttcatgtgacttgcagtcatatggcatatagcatttctccatggtcagtgcaaaggcttagcccatctgcatcttggcacgatatgaattgggctcttcctccaagtctgacaacagtacacacaatgaacactgaaatttcataagttctgctcaccaccttaagcaagggttatttaagcagctttctaaaaacaaaatcttatgtggaacctcacacataaagcaaataaaagaagagcttgctttgttaaagtatggataaaagtacccaaactttgcccctggtctccatcccaacctttctaatcacctcctgcaaagcccttggagcactctaactaatcttaaggctctgaaaaatccaactaaaaatatcacgaacctaggggaaacatgagaccaatatactctaggaaaagagcaaatgtcatttatacagaagtacatcatgacttgagctaaatctgatcaatcctagacaacaaaaaagaaaaaagttgcattaatcataaaagattgaattcatatttttattgatatataataattatacatatttttggaggtacaagtgatgttttgatatgtgtataatatgatcaaatcagggtaattggaatatccattacttcacatatttgcttttctttgtattgggaacattccaaatcttctagctattttgagatacacaataaattattgttcactatagtctttctactatactatcaactcctggaatttattccttctatctagtggtgttttggtccccattaaccaaattctcctcattcattctccccactacccttcctagcctctggtaattgcagcactattcacaatagccaagatatggaatcaacttctgtccatcaatggatgaatagacttttaaaaatatgctatatacatacaataggatgtcattcagccacaaaaaaagactgaaatcttatgatttgtagcaacatagatagaactagagatcattgtgttaagtgaaataagccattcatagaagacaaataccacatcttctcagtcatatgtgggagccaaaataatggatcatatcaaagtggattcagaatcttgaccagacaaagaaagagagaggacgtctccctcaattccagtagaacctcctctatgttacaactctagaatgaggctttttctccccaatcttctgtcgttgcttcccttacctggactgccctgatcatatcttacctggattcttgaactaaactacctggttaccctgctgttagttcctgacccatccagcaaatgagtagaacactttccaaagtcatctcactaaaaccaaatattatctcatagctttattatctgtgaaatatggagtaaagttcaaattacacagctttccccagaaaaaaaccacccttgaggagtccctgaccaaactctctggtcaatcctgcctttcttaactcacgtcctaaaccccagtaatcctgggaaaaattagagatcttcaaacttgctacattttatatctccatatctctgtaaatattgttctttctgcttacaattagcttttctctagtgtctacctagtgcaagtgcatctatccctatgcggatttcatattgccttctcctctctgaagacttttctaatcctctcaccttagccttgatccctccttccttgccttatcatggcactttttacatgctcaaaatgtttcaccaatcatactgtattacaattatttcatgacatgtcattgtgccaaacttaattgcaatttctacaggtgaaagggccaagtcttatttactttatcatcacccacacctaacacagtacatgacatcaggcaatggtttagtgacattcaatgaacgaattatggaagcaaagctttaagaaaataaatataggaacagcatggaaagtgaatcagagagaaagccacgtgcatgggatcggttaaacgggtattgagataatcctggctggtgataataataatgaggtaaaaataataatgaggcagaaaattgtcaatgcctatggagcaaggaataatactgggtatctctgaaaacagaatctgcaatacgcagcaagagtttgaaagggcagaaggagtaattgacaataaatccaaaattgaggccagagccaagaatgaatgattttaataacaagccttgggaaagcaggagggaagctgaataactcagttttgggaataataaacatggattctatgctgtgcacaatgctagctattgctgacatgttgcttttttgtactctcctcagttttgaaagcagaactcaggggagagtgaaggctcagaattgtcgactgcgtgacatatgtctaagagcactgagggtagtcatggtcaaggctgtaatctctgccatttgctcttctctcacattggagagcatacaataggaaaattttttaaattaagggagtattttctgcaccttaaaatgaatggtcccaaatgaaggaatttttttaaagaaacacatattttatatgtatgcacacacttatagtgcacttatttctgtatatataaaaacgcaaaaataaatatacaagtttttatatacacaaacatacaatgtttgtattggggaactgagcttttgatttttaatttttaatggcctctgttaattttcactcaatcagatatctaatttgatcactgtattttcgtgtctgaagtatatttttcaagggaatccatgttaacaatactgaactgttctgttaaacttttaaattattgtcagaattttttccttataggtcattcattgtaatggagtaagaatgaatctaaatctggattaaaagattttggtgaattgggagtgttttttccccagactcagaattaatgacttaatgctccctgaagatttcatatctataggcaacatgcaccatcttgctgagttaaaatcctagtaaggattggattaattctccatttctaatgagaagagaataataccaacaatgattctaattatatctcggacttgaagagttcattccttcctaggagctaaaggaaagtctgcatctgttacgtaatttatgcataaagacaaagtcatttgacaaaggttacactgtatgattagaatccaatgtgatagaaattctgcatttttgattctacatttagttctctttgctttaagttcccaattaaaaaaaaaaagaaacaataaattgtaacgtacaaaacgaataattctaatttgatgtgaggaagatatttctgagagacatttgtgagatttgagagtgtggattagaagaagctgtgaaatttttttactagaagtgttctaacataaagcagattcatgtatgtctgatctagtttgtggggatactatctgattgaagcaaggtgaaataaattatttatcaagatttcctgtagtcatagaattcaatgatttctctttgatatgctctgttacattttttcctaataagactcaaaaatacatatataaatgcaaaatgacactgttaaattgcttcctttttgcagggaataaaaggaagagacttgggctgaatcttttcatgcttgcctctctacagtttattttcaaaactgcagcaggcgtaatcctttaaaaacataggtcagaccattgcagcccctaatcaacactctgcatggctccctatttcacctggaggaagagccaagtcttttcaacagccaacagagccctacatgatctacagagctatctcttccccacctccccactacctccctagcctcatcctctgccctactacttgcctactctgttccagccatgctggctgccttgcggtccctctgctgggagcacgcctgcctcagggcctttgcatgtgctgtttcctcagcctgggattctcttccatgagttaaccctatggctttctgcctccctttcttcaagttttttctcaagtgttactttctcaatgagactatcctcattaccccctaattaaaatttcaaacttcgtccacctccactgaattcttttttttacataatatttgttactttctcacattcttcataacttgcttacttatgtttgtttttgttgtttctcccctccccccaacatctagaatctcccaacttctagaacatatgctcttgatgggcaagggtctttgtctattttagttgatgtttgttgattaatttcaaaatggtgtctgtcacatattaggttcttcatatgttttgtacaaatgaactaatactcattaactaagatgagcaatgattacaagtgactagtaggtagcttttattttgcaaaagatgtaatttctatataagcatattttagtcagaggagtaaaaagttgccattcctgaaaaattactcaaagatatactctagcaaattgaaagacaactgaaaataagatgaaaaggcaaagtataaaataattaaggctgaatatcaataccaataaaatatagaacgaaatcttgttcattttgttaacctttttaaatataatacacatttcaaaaacaattattgaaagagaaaacataatgtaataaaataatgtaatcataaagtggatctaaaagtaacagattaaatcagtacaaactgggaaatagaaaaaaaagatataagggacaaagtaaaaatggggagaataagttcccactatttacaaacagcatcaatggaataagcattattttagagtaatgatgccatgagaagaaaatgttcaagtacttttcttaaacctgacttccacataacagaccttcaaatccttgaagacagttgtcatgtcccacccagtgcttagtatgtgtgaagcatgatagactttgaactgtcccacatagaacagaagttcaagttcttctctcatctgagtcccctactcaagctcctcctgcagattggatgccagaattggacaaaaacttcagctgtggtccctgcaacacaaaggagagcacacacaccctctcacttgctctagatattttgcttttatgagtcaccttaagatcatgtttttgaggctatgttaatgactctcatggagttcttaccaaatttaattcctcagaattacgctacatatactctactgtgtacaaccaagtgtaggacctcattcttttccaactaaataacaatttgatagattttagctcgtggctatatcatgtcagtgcaattttgattcagcatattcatgaatcataaagttaatttcaactacaaatttgggagagtatgttatttctttatttaagaaatataagttattgggaaaatgctgaaaaagataatggaaaggacggaaccacgcaacaatccactagaaacctcccttgtgattgacatcaatgcactaataagcactattgaggtagcgattgagctacttaactgttttcgaatttcatatttttctatattaagaataagaacaatttaagattttcccaatttaagaatgagtcctggacaattatttctttaggttcttcatctgctaaccctatcatagaaataaattcggatatgctgttgtcattagaaacacgctggctttcttgtgacctttctcgggatatttacacattatcgcttaataatttattctaaaatctctttcaagattcatatcaatagtttgcataatttttcttcctactttttgaaaactaggaaattaatttgatatagctacacaaaagctgttcaaaaaaggtcaaacaagttcaaggaaattagtatgatatgctgcattattataaagcacactgctagatttctctgtaattatacttttaattctaaatcaattactttgagaatctatattaaactttgaatgatgaccaattaaaaacgtctttaaatggcattgcccttcaaaatggaatcagtgctaatgaaataaactgcttttgatattgtgaaaatctgattacatgattgcttctgtagctaattggacaaacttgcatattgaatgcttctaaatatctgcttctcttccacctacttttctatcatttggcagtgatgaggagggagaaaagaagaggtctcttagttgaacttaagatcttcaaaagcctttccatggtttattcatgcttgtcctatcctttggtgttgttataggaagatatttaaacttgcttgggtgttattaacattcctggagttatgattagtcttgaactgtagcctgtagtggaattccacagaagggtaaagtcatagtatcttatgttattcaaacttatctactatgcagaatgaaaaaataagtaaccaatgaattattacttagaatctgctgttttaagaacaagaatgttaaagaaaatttgtacatttaattgcttgggaggtcaaggcaggaggatcacttgagttcaagaccagcctgggcaatgtagtaagactcaatctctaaaaaatttctttttaaaatctagctggatgtggtagcacatgcctgtagtcccagctactgggtaagctaaagtaggcactagagcccaggatttcaaggctgcagtgaactatgattgcaccactgtactccagtctgggcaatagagcaagaccctgtctcgaaaaaaaaattagttgcttgatggtgattttaaaattcagaatgactttaggtagtttaggttatgtctctatgatgtaaaaatggtcaacttagaaaaatgtaaagagtaggaagaaatctctcagacaattttggaggttcaaatgtacttgacaattcagagaagttacacagggtaaaataaagaggcaaagaacctgaagaccacgcagattccacatcttgtgcttaaacactggtgctttcggtcaggttgttacaactccctgaattgcaatttccttagctaaaaaatggagaaataatattttccagaattgcctcaggataatttcattcaaatgtggaagtgtcttatgaactatgaaatgcactgcagactcccagaaatataatctctttttccattcatcccctaattcaataagtatggtcaatttggcagacatgtattatttaaaccttgaatcacctattaatcatcacctttggcaaagaaaatggagatgcaaaagtaggttctgtataaaaagcttaaatacatgatttgcagcgaagctgtatttactcagttaaaaaaagaaatttatcttagaagccagttttaaaatgataattaactgttttgtgttgtctagttaactgattcttcaacaaacatagtttgaagaagttagaccttttgttttatgcaaaataaattatcatcagaccatattttctaagctgaaaaatattgtatttttatactattgtcttccatccatttagtttatgtaccttaactgcttcatggtgctcttggccagaaacaaattatttctaaatattatgtttgcattttgatcctttatcttaactgtaaaattatacatagctagtcttttctcttataaacccatctgtggttgctgaaaagtaaattattttgttgaaggtcagcattaaatccagccagatttaccttttattaatccctgtttgttgcttagggattttatcactgtgctagaaccactttttggccccagaatcttttctctcaatttaattcataatgccactataatgcaatagatgttaggatttggccatctgggcattttaaaacatggcagcagaccagtggagtctcagtttggtgttgcatctgatgttccctccttactacacatgaccagccatttttcaaaaatgcagagcctgtgtccaacagtttactgtggccacatgagctttagtcacgctttgtaactctcaattagaaaaatctcaaatttagtcattacaagttttatgggttgtgagagcacaaggggtccttaaaatgaccagacagctgaaagacgtggcaggcagtgaaacatcaagcaaggaagtatcctcgcaggccagtgactaacgatccctcctgcgctcagtttatgttgaaattaaagtaaaatcctattttcagtattgagtaaatggggtcgctagaatgctatgcaacagaattatatgtggaaaaaaatgatgtgacgtatacaattacctcagctattcaaattagctcttttcagaagtggtctctggaaccctgtttccatcatttggcaatgagccagagggaaaaacaaatatttcccaggcttctctcccaaccgaggagctgcacattcttcaaaatctcagatttcacctcttatttgaagcctgtcttgcatggccatttggaactgacatttctgctgcaattccaaagcgcgaactccgggggctgaagtccacctacgctccacttaaccccatatactcagaatgcgcagtgcggcatctgtccactgggggcgtctttttcctcgaattgcgctagggctccccagcggctaacagtagccacctgcgcttgtgttcgcgttatgtatcgtttccatccttcgtggcttgatttagttctttatactctcgtcctcatatctggattatagatcgttcccacagtgtcttcacacttgacctgcaaccaaaggatgctcaaagtcgggtaaatatatagtatctaataaatttctgtaattctcaattcttctacagtggcatatgctcattcgaagaatttgagtatgtcattctcaatttgagtatgtcatgtgtattatatttgacataaatatacaacttctaaaccaatattttttgtatcattccactcagaaagtatccagtttaagacaggagaatacacaattataatgtttaaaaaactgggatggggtcaaaggcattggaaaaatattttaatatggagattacggacgttacagaagcatatgtttggttattacaatcttgaaagttagatttttatgcacatattatagaaagacaaaatttctgtggaaaatttgtttcctgatcaaattaataattattgtacttgtattaccaagggtaaataccaatgactaaagtaaacatcgtttatgtggttttctagatggtttcaaatttgaaatttagaggctggagactagcactacattttaaccactcttgtaaattatgtcaccaacatgctatccttattcacagatctatttttgaaaaattctagatggcttgattttaattttatctcaaatagttctgttgttgtagaacctacttagaaacatttaaggtttagtttccagaactttgttctaggaaactttgtttggtttcacttggattcctagattaaatttaagattccttctgtagaaatattatgaccacatatacaacatgtcaatgtaaatgtcaatgaagccatataataatagaaggattaaaaataaaacccacagggaattatgctgcactgaatcaaattgtcagcattaatgatcgcctccgtttacacccatatgtcattcctttcattctgtagcatcgtgggaatgagcactattagagtaatatattccaaaatagctcattatgggtgggggttgggaaagagaaatattatttcatatcattactaataaatttaattacctgtaccctgctagcagtacatacattcattactttaatatattaaaaatatattacctaaagccacagttaactaagtaatagcactgcttaatcttatgatattcactgtttttggtcatctttcactagatattctctgaagcaaattctcatttttgttttaacaatattattatctaatttagatttttaagatcaacagaacattttagcaagataattattaaagctaggcttctacatattttcctgtatgtaccattaaattattccccaactccccacaaattgcctaaaaaaaactcaaaacatttagatatatcagctatttaaccaattttattccaatttaattactaattacttagaaattaattgccagtttcatttcttgagaactccctcctaaaatcttttgcggtaatgcaatctggatttgttaagctatgtgcccagctctcattcagaaatctccctgcggaaacatcctggggatttcctgtctccctcttgcttggttttctctctcatttagtggcgcacatcttggtgtgcacaggaagtacatttgttgagacttttatgtttaatgtatttttatttaagctacacacttgatctattatttgtctaggtgtaaaatgctgggcataacatcattttttcattatattctttctatattctttagcacccagtatcactggtaagaaagtcaaagccaatttatatcctaatcttttgtttatgactgttaccctaccctgaagcttgtagcatttgctctctgttcatatactctaaaatttctggatgacttgattggatattggtccattttcatccactgtgctggttactccatagactctttcaatatgtcaacttacgataattgatttgagaaatggtctcaaaatattttattgctcattcagttcccttcctctgttccaggaacatccatatttggttacccatcttccctggttgaatgtttaattttcttatcttttctttcttattttcatcttttaaaataatgtatcttctagaagattttttaactgtattttctaaactttctaaatgagattttagtttacattacaatatgtttcatacctaaaagatcatttttttctgcctaaattttccctttttatagtattttaatcctcctccatagttataatattttatcttggctttctgcagatatgaacaatagtccttttttctagagaaggagagctatcttcatcattagggtgtctgtttctttcaagtactttgtatgtttcttcctgtttgttgtggtctctgttccccatttttgtggctttactcaaacgtctaacaattcttagttgtaggctcatatgtaaaagttgggataagaattgctcaaaagctcttaatacgtgctgtgagtcttattgccagtctccttcatagtaagatgacagatttggcttgactctccagctggtcagatatcccaaagagagccttctagatttccacctggaacaaaagccaggattcctccttgcaagcttataaacttttcttaaaactcttatttacatttcaatgacatttgaggaaagaaccagagcatatttgtccaaccaccatcttggccaagaattcccttttctttcttgatagtgttggcgctagagcataacttgcaaaattatgtaataactaaataattgttgagtgaataaatgattaatagaaggaatctaagaagttaaaaaggattatccttactacttatttgtgttttctttaggaggggttttactttaaatccaatgccaaagtgtctgaaagtccttaagaacttattgaatggctcatttgttgctgagaacaatgatttggttaaatggaatgaaaggctttaagaatctcccatttttttactggcaatacctggcacaactcagaaccataaaacatcttttttataaaagttgatagtactgaaggtacgtcatatttgatatggatatgaatgttctaaaaagttgcataaatatgagattatgaacaatttctctttcactttatactactttatcatttttcaactaaattatcgctaagaatttcagagtttagtctttcatattttgaggaactgagagagtttaatgaggagaagaccaactgaacagagaccctgaattatagtttgattcgagggattatgagagccctttagagacaacattggacctagcaattggcgcagtccggggaagcggggctctttacaggcaagacatctcatgctggacatttagccagtcctctctggaaattcatgactttttttggaaacttttcttcaattatttgttgataatcttttcccttccatattttgtgtcctttgcctttcgatgggaatttatgtcacttaaatattgggtattctggactgttcttctatttcttgacttttctactttctatttgttaatttttttactctactttcagagaggtttcttaaaattttgtcttctaatctttctattgaatttttcgcttgtgcacttatgtttctgatattgaatatattttgttgttgtttgagttttctgcattaaagcaacctgttcatggtttctgcatgttacaaatagctttgttttgatttttctccctgcatagtgtttcctccaagttgctttagatattttgttgtttgtttgttttgatctttatggcaggagcctttccacaggtttttctcatctttgactttctatgcattcctgtaagtaagggatttaaagcctgattgctcctgataaacacatgatgggacttctccactctgagctacattgtaagttgacctgtgtgagtattttattggggaatcccaatagtttttgtctttatcttttctgctgtagagtggatcaaattacccaggaaagacttctaatttctatctacaggaaggggtctagaagccagctccaagtagaagaaagagctgggggtgtttgcattcagtattcagtatgcatctgatgatgaatccccatgttgtcagtatggtacatacacacaactgtgtgtagcattccccagctgaagatcttattttccctttctagtgaatacatctccagatttttaggggaggagggacatgcagcagtgaaacatcagatatatatttggttctcagacatattctacctaagctgccagagttcagaaccactcccttcgtcttccttctaaaagtaatggatactttcaatgattctgcaagtgtaaattgggtttgtccctacccttccctactgatggcagtttccattcattcgtttatagtttccgaaactgtgccctttactgctcctgatttccccatccttgtggtttatatttttaagaatatacacccctttgctatcatttttgtaagtatgtcccagtaatctatcttaatgaaagactaaaatggcatatttttaatatttacttatttattatttttatttttccataagttattgggatacaggtggtatttggttatatgagtaagttctttagtggtgatttgtgagattttagtgcactcgtcacccaagcagtatacacttcaccatatttgtagtctttcatcccttgctcccctcccactcttcctcccaagtccccaaagttcattgtatcattcatatgcctttgcatcctcatagcttagctcccacatatcagtgagaacgtacgacatttgagtgtccattcctgagttacttcacttagaataatagtctccaatctcatccaggtcactgcaaatgctgttaattcatccctttttatggctgcatagtattccatcatacatacatacacacacacacacacacacacacacacacgcacatatatataaaacacagtctccttatccactcattgattgatgagcattttggttggatccacaattttgcaattgtgaattgtgctgctataaataggtgtgtgcaagtatctttttcaaataatgacttgttttcctctgtgtacatacccagtagtgggattgttgaataaaatggtagttctacttttagttatttaaggaatctccacactgttttccatagaggctgtactagtttactttcccaccatcagtgtagcagtgtttcctgttcgccacactcacaccaacatctactgttttttgattttttgattatggccattcttgcaggagtaaggtagtatcatattgtggttttgatttgcatttcctgatcattagtgatgttgagcattttttcatatgtttgttggccacttgtatatcttttgagaattgtctatccatgtccttagcccactttttgatgggattctttgtttttttcttactgatttgtttgagttcattgtagattctggatgttggtcctttctcagatgtatagattgtgaagattttctcccactctttgggttttctattaactctgccgactgttccttttgctatgcaaaagatctttagtttaattaagtcccagctatttatctttgtttttgatgcatttgcttttgggtcctccatcatgaaatcctcgccaaagccaatgtctagaaagattcttccagtgttatctcctagaatttttatagtttcaggtcttaggtttaagtccctaatccagcttgagttgatttttgtataagctgagaaatgaggattcagatttatttgcctatatgtggctagccagttaccgagcaccatttgttgaaaagggtgtcctttccccacttcatgtttttgtttgttttgtcaaagaccagttggctgtacatatttgggtttatttatgggttctctattctgttccattggtctatgtgcctatttttatactggtaccatactgttttggtaactatggccttacagtatagtttgaaatcaggtagtgtgatgcctccagatttgttctttttgcttagtcttgctttggctatgcgggctcttttttgataccatatgaagtttagaactgttttatctaattctgtgaggaatgatgtggtattttgatgggaattgcattgaatttgtatattgcttttgtcagtatggccactttcacagcattgattctacccttccatgagcatgggatgtgtttccatttgtttatgttgtctatgatttctttcagcagtgttttgtaattttcttcatagaagtccatcaaccccttagttaggtatattcctaattattttattttttgcagctattgtaaaagggttgacttcttgatttgagtctccagttggtcactattgatgtatagaagagctactgatttgtgtacatgaatcttgtatccggaaactatgctgaattcttttatcagttctaggagcttgctggaggagtccttagggttttcaaggtaaatgatcatatcctcagcaaacaatgacagtttgacttcctctttaccaatttggatgccttttatttctttctcttctctgattgctctggctaggacttccagtactatgttgaagaggagtggtgagagtggacatccttgtcttgttccagttcccagagggaatgctttcaactttttcccattcagtattatgttggctgtgggtttgccatagatggcttttattacattaaggtatgtcccttgtatgcagattttgatgagagttataatcataaagggatgctggattatgtcaaatgcttcttctgcatctattgagatgatcgtttgatttttatttttaattctgtttacatggtgtatcctgtttgtcaacttgcatgtgttaaaccatccctgcatccctggtgtgaaacccacttgatcatggtggattatctttttgatatattgttggattcagttagctagtattttattaaggattttagcatcatgttcatcaaggatatcaatctgtagttttcttttctggctatgtcctttcctagattcagtataagggtgatgctggcttcatagaatgaattaggcaggattccttcttcctccatcttgtggaatagtgtcgaaaggattggtccaattcttctttgaatggctggtataattcagctgtgaatccatctggtcctggactttcctttgctggtaatttttaaattaccatttcaatctcgctacttgttatttgtctcttcagggtatccaattcttcctgatttaagctagaagggttgtatttttccaggaatttatccatctcgtctacgttttctagtttatgtgtgtaaaggtgttcatagtagccttgaattaccttttgtatttcagtggtgtcagttgtaatatccaccgttttgtttcttagtgaggttatttggattttctctcttcttttcttggtttatcttgttaatggtctctcaattttatttatcctttcaaagaaccaacattttgtttcatttatcttttgtatttattttttgtttcaatttcatttagttctgctctgatctttgttatttcctttcttctgctgggtttggatttggtttgctcttgtttctctagttccttgatttgtgaccttggaacgttagtttttgctctttcattctttttgatgtaggcatttagggctatgaactttcctcttagcaccgcctttgctgtattccagagtttttgataggttgtgtcattgttgttgttcagttggaagaatttttacatttctatcttgattttatttttgacccaaagctcattcaggatcagattactaaatttccatgtatttgcattgttttgaaggttccttttagagttgatttccagtttcattccactgtggtctgagagagtgcttgttataatttccattttcttaaatttactgaagctcgttttatggcctatgatatggtctgtcttggagattgttccatgtgctgttgaatggaatgtgtattctgtggttgttggatggaatcttctgtatatatctgttaagtccatttgttccaaggtgtagtttaaatcattatttctttgttgactttctgtcttgatgacctgtctagtgctgtcatggagtatgggaatcctccactattatttgttgctgtctatctcatttcttaggtctattagtaattgttttacaaatttgggaactccagtgttaggtgcatatatgtttagggttttgatattttcctgttggacaaggcctttcaccattatataatgtccctctttttctctcttaaccactattgctttaaagtttgttttacctaatataagaatagctacccctgctcacttttagtgtccatttgcatgaaatgcctttttctacccctttattttaagttcatgtgagtccttatgtgttacttgagtctccctaaggcaccaaatggttggtgagttcttatccattctgtggttctgtatcttttaagtggagcatttaggacatttacattcaatgttagtattaaagtatgaggtattgttgtattcatcatgctcttcattgcctgtgtactttgtttctttttcttttttgtttttgtttttaacttgtatttttgtttgataggtcctgtgtgatttatgctttaaagaggttctgttttgatgtgtttcctagattggtttcaagatttgttcctttcagcagttcttgtagtggtggcttggtaatggtaaattctttcagcatttgtttgtttgaaaagactgtatctttccttcatataggatgcttagttttgctggataaaaaattcttggctgataattgttttgtttgagaaggctgaagataggcccccaacctcttctagcttgtagggttcctaccgagaaatctgcagttaatctgacaggttttcctttataggttacctggtacttctgtctcacagctgtaaagattctttctttcatctcaactttggataacctgatgacaatgtgctaggcaaagatctttttgcaatgaatttcccagttgttctttgtgcttcttgtatttggatgtctaggtctctagaaaggctggggaggttttcctcgattattcccccaaatatgttttccacggttttagaattctctttttcctcaggaacaccgattattcttaggtttggtcatttaacataatcccagacttcttggaggctttgtttgtatattcttatttttctttctttgtctttgttggattgggttaattggaagaccttgtctttgagctctgaatttctttcttctatttgttcagttctattgctaagactttccagagcattttgcaattctaaaagtgcatccaaagtttcctgaattgtttattgtttttttctttaagctatctatttctttgaatatttctcccttcacttcttgtaacattttttggatttccttgcattggacttcacctttctctggtccctccctgattagcttaataactaacctcctgaattctttttcaggtaaatcatgcatttcttcttggtttggatccattgctggtgaactagtgtgattttttgggagcgttaaatagccttgtttttcatattaccagggttggttttctggtctcttccatttgggtagcctctgtaagagggaatgtctagggctgaaggctgttgttcagattattttgtcccacggggtgttcccttgatgaagtactcttccccttttcctatggatgtggcttcctgtgagctgaaatgcagtgattgttgtctctcttctgggcctagctacccagtaagtctacccagctctgggctggtactgggggttgtctgcacaaagtcctgtgatgtgaaccatctatgggtttctcagccatggataccagtgcttgttctggtagaggtggtgggaggttcagtggactctgtgagggttcttagttttggtggtttaatgctctatttttgtgcggttggcctcctgcgaggaggtggcactttccagagaatatcagctatggtagtatgggtaggaactggcagtgggcagggccctagaactcccaagattatatgccctttgtcttctgctaccagggtgggtagggaaggaccatcaggtgggggttggggtaggtgtgtctgagttcagactgtccttgggcaggtcttgctgtggctgctgtggaggatgggggtaagattcacaggtcactgaagttgtgtacctaggaggattatggctgcctctgctgagtcatgcaggttatcagggaagtgggggaaagccagcaatcacaggcctcacccagctcccacacaaaccaaagagctggtctcactcccagcgtgcaccaccctgccaacagccctgagtgtgtttccaggcagagggcttgaaaacttgccccagactacccgcctctcagccttgaaagaaaagggcttggttcttccctgtgaagtctgcacactgggtttgtgccctcccctgagttctggccaggaggtttctcaccccattcaaattattacaaagctcaactagagatttccttctccctgtgggattttactccctgcttccctggccactctcctgacagatccctgtggtgccaggcaggaatggcctgctagggaacccagccagttcccagggcctttctgctgctccctctaccactgtatttcacttggctctctaaactgactcggctccaagtaaagtcggaaacttctcccacaaacagaacctcagcttctccagtgggagtgtgtgttcggtagaggagagtttccctttcctgtctccagagtgggggcactcacagtatttggggtgtctcctgggtcatgcaggagcagtctgcttccttcagagggtctatgggtccttttgggattgcttgcacctgaggtctgagtaaggagcagggagaccttgggtagtgcagggctgccaccagggtgcacacacacttggggtccgctgtcagcttcttggtttttatttttgactctcatagcatatgacaaaagcttgcacgtagtagacacttacctggtatttgtaggattgaataaatgaatattttaaacacatccaaaacgtagaactacagcatttgcacatgctacagatttatgcctttaacaaattaatgaaattaaatgtctctttcctcctccagtaatgcaacatatagataacttcatcagtttaaaaaatctatattgcaaaaagttaacaataatttgagtgagcattttatctatccctgtgttcttatctatccaacaaacacttattgagcaacaacaatgtcactaataaacaccaagattaatgtttgcgttttgttatacaacatgtctattataaactggacatcattcaattagtaaaaaagtcccttcaataaatttttatatattgagacttgttatttctcaaatcaagaacagattgaagtaaacatttctatggtttatgtgtcactaaatagaactttgatatatagactctcacattctattactaaatttaataatgcaaatggagttttagtttattgcttctgtataaatttcattaggtttctgaggaagctgtaaagctaattgtaatgtatttggaatttggttagaaacaggttgcttttattaatagttttttcaaccagaattatataaaaccactagattgtgatagatcagattcaatttatccagatagtataatatttccttaaggatgtaacattagagatgtaacataatttttgtattggatgtttcatcgataaaagtttatggatcagcaggcaatataatttgccatacctctccatttttcatttcagaaataaatcattgcttgtacaagagtatgacttttttatgttacagtttcacagactgtaattggttctgatttatcttaaaaagtgtaagatttatattcagataggtttattgaagtgtaaatctttaaaggatgacagcattatttttaatgtatatgatatttttaaaaagtaaaataacatactagggtacctaactcaaaaatagaggggacttcattgaaataaaaaagaaaaaaaaatacaggagactgcttttcttagctataaatctttgtatttatttgatcttttatatcatatgtatgttatttattaaaattaaaaattaataggaaataaagtagctaatacctattgagcactttctaaaagccagaaaatctgctaaacactttatatgggttgtcccatttaatcctcaaaatagccctatacattattgttcttcacattttatagattagaaaaataccaaggcttaatataaaaaataaaagaataagatagtcatgttaacaatagttaatatttaatgaatacaagctatgtttagggcactgttctaagtgtttcatgtgtattatactatttgagcctcactacaagtatgaaataggtgcaatttttctttttttacaaatgatccaaaaatcacagggccaaaattcaaacacaagcacctgcattcacagcttgtgctaaaatacgatgcttggatcacttgcaaaactttatgctacaagtatgagaaactctgacacaaaatgcctccaacattaaggtcattaacagtgctgtttgtttagttaattcttgcactgctataaagacctgagactgtgtaatttttaaagaaaagaggttgaattagctcacagttctgcaggctgtacagatagcatgggtggggaggcctcaggagactttcaatcatggtgaaaggtaatggggaagcaggtacattatcaaatggcagcagaggagagagagagaagtaggaggtgctatacacttttaaacaaccaaatctcaggagaacttactatcacaagaacagcaagagggaagtccacccccatgatccagtaacctcccatgaagaccctcctccaacattggagattacagttcaatatgagatttgggtggggacataaatcgaaaccatatcaagggcacatcacaaagtccagaagtagagccagtgtccaggttgactaatgtgataatgtcataaaaaacctaggttcttcccatgtctctgtttagcttctctgctccttgtgggctttcaattaaagcaagctatttaaacttattgaccctaaatatattcaaatgtaactgagaatgacagcctttcagtgttggtgcaagactggaaacaggaagactgcatcatttccaagggttcatatctcagtacctcagtttcctcatctgcaaggtcaacataatgatattatctatgctgtcggtgttgtgaggattaagttgagatacataaagtgctaacaactgtgtctgtcacactgtaagtgctacagatacatttgttgttgtcattgttacgttattgtgacaatgtcaagaagaaattatggcactgccttagatgtggatttaattaaattgctgcctggtgggagttggatttcaagccaattcctgaagaagtcacctaatgggataataggtttacccttagaccaacagctgggacactctggagctgagggtagagtcaccttttctgaggcacaaggccatgcagggatggggcataaaaggagcagggtggcaacaacctttcctgtctgctatgaagatgacataaaggcacttagcacaggggtgtttagagaacagggagcaaggcagcattcttggagcaagtttgccttccatccctgccatggaactgctatttgcttgaaacacttattcctcatttaaaaaatggaacatcactcaaggttgttttgactgaatgagtgtagatcctgttcctccttttctacttccatggtgtccctcctgtagctgcacagtcaatgaacctcccaataagaagacacccctttccacagcccttttttgtcaatgatacacaagacaccatgctttcctgccaggccctacaaacaagtgaaaatgataatacgtgtcatcccgactttagagaatggttttaagaatcaaatatgataatatatgtgaataaatgttctttaaacctgtaagactgtatatagcagtgaaggataggggttaatttacacctacaagatttctgatctatctgctagggtgcttcattagccttttctgataatggattcatgacagttgtacattagaagctatgtggatcactaacccatgacactgacatcttagttataaaagtgagcaattttatagaacacatattagcgagaacattaacaaaatgatcagaatttgatgtttcctaatgggccattatatcctttttgttctttatttttaaagtaggttaaaaaatacatgaatctgtggcagagagattaatatcattctaaagagctggcatcagaacattaatagatatacagagtttctccctttgacctggaaactggaattctgagaagaaaaaaaaaaacaaacaaaacaaaacttagagaataacagctgtcaggaattacctctcaagaaatccaaactgccagccatggtagctcacatctataatcccagcacttatgagatgaggtgggaggatcacttgaggccaggagttcaagactaacctgggcaacatagcaagaccctgtatcttttaaaaaaataaaacccaaccaaaatttacctaaacattaacatttgttactgaagatgtgcctgatatcctaaattaccaaagcagctacatcaatgactgaattatcatagtttcaattctaccttaaaaattactatgtgaaagggctttcgatcaagaagtagcatgaatgttatagcaaacaagggcttgactagagctgaaaagagtttcatacccagaatgtagagtgtgaagaggtcacaattcagtaagtaatcatgtggcttctattgctgagtagtcacagttatttatagaaagaatattcattttctatttaaagtattctttaatattttggaactacttcacttattttcctacaagtatcaggatattaactataacatattaagcttctcaaatttggaaggtgactttttttatgtctgcctatgctttatgtgttgctttcatcaattagtgacgtctgcctataagactggtattgtaacacaggagactttgaataaaaccaaagttgtgtggcttattgtgttttatatgctttattgtaattaagggtttttttttttacagtagcaagtaatgaataatcattatccagctaatttgatcaagtgctaattttgaattctaaattggtcaaattaatgtttaaaagtgttcagtattaatatatgcacatattgagattcttattaaacaagtatttagttttattatttgttatgtatgtctgtttcagtatgactatagaaaataaaccttatgaatagatttttgaatctttttaatttactagacaatagttcccaaaaaatctttgtgatggtgaatcagatggcaaaaatgataggtgtaagaacaaagtatatggctttttgagaacatgactgcctttaggttatttcttagcgtccttaaccataggtaaatcacttggttagtatggtgtatcagtccattctcacactgctgataaagacacacttgagactgggcaattcacaaaagaaagaggtttaattggacttacagttccatgtggctagggaaattctcacaatcatggtggagggtgaaaggcacttcttacatggtggtggcaagagagaatgaggaagaaaaagtggaaacccctaataaacctgtcagatctcatgagacttattcaccatcacgagaatagcatgagaaagacaagcccccatgattcaattacctcccactgggtccctcccacaacacgtgggaattctgggagatacaattcaagttgagatttgggtgggggcacagccaaaccatatcatatggcatactacttgtaaaacaaccttatcaataaaggctgagataaacagaaggattatttattatataactgtgaagttaactgtacatatttaatagtatgtaattccccagtactttgtttccagaatcacatctaagggacaccaggttaactgactaaattccaagacagtcaaatcattatttgttgatgattttttaaaatacatttcaattcaccttgctaattcatgtatcttttttccttaatttattaaactaatttatctgtgtaagcacagtattatttataggaatattgttctttttaacacatcatttaaaatattcaattgtggtaaaaccattttttcaaagtagcttagcagaacacagacaaggaggcaaccaattcttgattccaatgtcaagtctcattggctgtcatctagagcaaatttatatctatttttaaccattttctttgctatattcctttacttttttttttataatgtacttcctcactctaagatattcattttggttttctctaattcttttatagtttacattttatgtttaactctttaatatatgtggaattgatcattttattttaaagtatacatgttgttttatttaagaccaaataattcattcaataaatatttattacctgctcattatatatctgaccctgtggtaggcatcgcacataaatagatgatttcatgctagctcttgagagatgtaaaatcagcgggcaacacaggctacgaaaagataaattacactacagtgtggaaaggtccaaagagtaataaggagacatattgttgtgccaatggtggtttctccattgattagggttctgtttcttggtgcactgggatgctgagttcatagtaaactctctttacaaagcagggctcacattagtggataaaagcaggtgtgcggttgactatggcctggctcaggactgctgaccaaagcttaacaagaacaatagacaaatgtcactggggaagcactgttgctgccactctcatctcataagtccaaaaagagtagagtattgtgattatttcccagggagatattaggcatagaatggtcctcataatttttgtgacccattacttcattaaaaatctgggaaccataagaaactaatctaccaaaaatggatgcttttcttgatgctaaatttgtgttgaccagaaccctggttatattctcttgggaactagcctcaacattttaacccaccataaaaagctttgaaaagttctgacatgatctagtcctataaatcattgtcctgtaattagctgagattttgtttggctttttcctctgagcatatggctttgttctgaattgattttcagcaaataatcaatttgtcttatactatgcctgacaggtaagtcataactatcaccaacactaatgccataagttggttaacatttcctgtaatcttctgcatacatttatacatttctttctttttttttttttttttttttgagacggagtcttgctctgacatccaggctggagtgcagcggcgcgatctcggttcactgcaagctccgcctcccaggttcacgccattctcctgcctcagcctcccgagtagctgggactacaggctctcgctaccacgcctggctaatttttttgtattttcagtagagacgaggtttcaccgtgttagacaggatggtcttgaactcctggccttgtgatccgcccgcctccgcctgccaaagtgctggaattacaggcgtgagccactgcgccgggccgatatttctatcagatgcaagaattatcacaattcagatatagacactaaacaaaagccttcattttatgtaggattgtgtcaaaatgaagtatttataaaaataagaagctataattcatacatcccaagttagaacattttttaatattgagaataattacataaatagtccagaatgccttcagtaataattcctgatattttatgatgattaccttaacacatttatacatttacattaaattacagaaacatattcatttctaaatgttaataaataaatatgcattgtgtgtggtacattctattacaactctctgaatttcagagcagaattcatggtcatgagtaaaataaatgcccaaacaataccatgaattattaaatatctgtcaaaattcccaatggaattatgatttcataatttgaattctgttttttgttaattgtttataatgcatggatccgacccatggattccaggtttattgaatgttataaaattctcttttctcctgtgcccaggcagtcagtctttctgactaagctaacaatggcaatatttattccctttttcctccttgaaaacttttttctatagcatattctccaaaggcaatgatgactgactcaagccatcaagttatatggcctcttactgcaaattgtttccatttgttggagggctccagaagaagctactattttgatcctgaacaaaggagaggagttgagaataagagggaaattgttcttcaagttaacttgcacattaacttgttcatagaagaggtggctgatatgttttcagcaccctttcacttaactgtactttggagtttttgcaattacagtccagacttacttgaactacatgtggtcgatattatgcatctgccgcatcgcttacttcatgcgtctttatagagagccacgtaagagcatatactgacctctgagatggtgtgaaacagtggagaggcaatagctaggaaaatctttgcccttataaaatttatgtcacacatgctactctattcattactttttacgtagccccatctgtccaggagtaaaatatccctgtagcagagtcacatatagaagccggaaatttaaaatatgactttccccaaatagagccaaatataccagagagcataatattttgctgaagactgcctcaattctaaaatataagaaaactatgagagttttaaattgaaatttttgtaacttgcctaaggtattatcatactgctactttgtgcttggcctgaaattagagaatgttaagcaggtaagtgaaaattaaactcctcaaggatatataaagagtgcaaattctactatttcaattctcctttgattcaagtttaaaattcaggcaacagcttcctaggcaaactgagatgctttttttcctcttaacgatgagactatgattagaacaccagccaaactgtgcttcttaagtctcactcactgggtctgtggtacaactgctggctttgtgcactataagtccttcttcagccaagtgttgccttagagtagagaacaatgactgtaaattgcctttgtattgtagatatgaacaagaaaaaaatatgcattcattcttagagatcttgataacctagtgagatttttcaatttataatgatctctatgtgggaagattattacattcataaggaggaaacctacatcatttgaagactccttgtgtgttatttaaaggtgaaatagggcagaacatagacaatggttgtggcctcaactgttgtcacttcagacaccttgaaacatgtagccataataatctactcatcgtctcttgaatattccacctggcaagtgtccctgtggatataatcctaacttatgatagaagagttgtttcatggctagagacaggtctgtgaaagggaagagcttttccactttggataagaatatttgtattcatctaggtgtttatggaaagcatagctaagtctaattttggggagaaaagaggatgttttaagattagccactatcagtaaggagaacaaccagaaattgaccagtgcctcatagaagaaatggtctccccatgatctgaaaatttaaaagaatgtaaatattgtttggaaaatttcaaattcaactttaattaaagaaaagctaaaagtgccttgcttcatttaaggaaattcaagttgttgagattaatctttgccagtaacaataaaatcattcattttctaatgaattaagtagtggcttggaagccctctgggctccttaaaacactacgaaagatacctccatgatgcagccatgaatttaaaaattttgaagaatgaaataaccctcattatcattcctcccaacaaattaaataggaatactacaaaatgatgttcatgatttagataagtcctttgtggccattggcccttatacactcatgaactatctggttagtaataattttgtttaggtgagaggcatacagctaatgttggcatgaagaatctgcaagattggtatgattacttaccgtcaaatcaaggagtccatggagacgtgaagagagacaatattcttaaaataaatgtagctacagtgggcagatgtgggagtttcatctcagttcatcccatcccccatagcaaagtgaatagcatccctccttcccacacagacacatcaaaatatgtatggaacactcatgactctaatggagagtcaggcaacaagaatgggctaacaaacatctcatggctacagtgaaaatccacccagggagttgtatttgaatcattgtctctgaaacttccagatcacaagaggctgtctcctacagccatccaagatggttagtcaacaacttgagattggtggtgacaaataagaacctgccagagaggtttttaccatcttcaactttgcaattaatcagaactgtttccagccttggtaattatttcagcaaaggaagcaattaagaaaaatgtcttattttgcagaggattcaaaaccaatcagctgccgcatccataggtcaaaaaataacaattttgttctatttattcagctatgcttcaaaaatggaataactaaaataattatatgttttttaaaaaatcctatcacattaaaacaacatttattatttttctgaaaaaagaaatctttttctacctaagttgaaaaataagcatatattcttcccaggtggtaaatttaacaaaaaacacacacacaaaaaattgttttgtgtaaattaggtaaaatgtgtgcatacatgcatacgcatgcatgatttataagtacaccaaactataaatgtaacacattagtaccagcatgaatcacaaaggtagcacaattttatagtcttaaaatcctaattagcataaaagggaaaacatcgtaatcaaataactattgattaacacaaagccggatgtgttgaatgggtttagtaattaactaaggaaactgcaggtgtttaaaactcatagattactaatgaaatgtatacttatttttaaaaaaattacctgtagctgaatcttatcatattcagatacagcaataacacacagtactcatagatgtaaactatactgtcacatagaatacttaaagcatcccttattaaatgtcttaggtgttcaaattctttgaagcttttgctaggctgttttcacaaggatatatctgattctgcctatggatctgacacactttaaaagtagacaaagcagtataaaggaaagcatggataatgaatgaccaactaagaaataatcacagataagagaagaagagcatgacatttaaacgaaaatgctttctagcaaactacagattttttctaacttcttactgtgttttctctgcattccatcaaggtggtccagcagtaaaagtagacttcttcacatcactttgtgttataggactaatgatttcttgagttattggtaggaaactggaagcttttatttggtcccttccaacagaaccaaatgacacggacaagctaactgaaggaatgaaattaggttgtttttaagcacggttcatttccttttagtattgtatactgtctcgcttatttcgattatacataagaaagtatgcttatcctccctatacttatttattatttttgtttttaaattttttatttttaatgtttgtgagtacgtagtaggtgcatgtttacaaggtgtatgagatattttgatacaggcatacaatgtacaatacttcagagtaaatgagatatccatcacctcaaccatttatctttgctttgtgttatcatccaattattctgtattagttacttttaaatgtacaaaaactattgttgactgtagtaaccctgttgtgctatcaaataatagttcttattcattctatctaactatattttggtaaccatttaccatccccactacaccctactacccatcccagcctctgataactatcattctactctatatcctaatgaattccatagttttaatttttacctcccacaaataagtgagaatatgtgaaatttgtctttttgtgcctggcttattttttttaacataatgacttccagttccatccatgttgttgcaaatgacaggatctcattctttgttatggctgaatagttctcaattgtgtatacataccacattccctttattcattcttttgttgatggacacttgttgccccaaaatcttggctattgtgaagagtgctgcaataaacataggagtgcagatatctctttgatataccgatgtcctttctttcgggtttacacccaccaatgggattgctggatcacatgatagcttttttttttcagtttctttaggaacctctgaactgttctccacagtggttgtgataatttgcatttccaccaacagggtacaagggtttctgtttctccacaccctcaccagcatttgttattgcctgtcttttggatataagccattttaactggagtgaggtgatatctcattgtagttttgatttgcatttctctgatgatcagtgatgttgagcacctcttaatgtatctgtttcctatttgtgtcttcttttgaaaaaatatctattcagatcttttgcctatttttaaatcagattattagattttttccaatagagctgtttgagctctttatacattctggctattaatcagatagatagtttgcaaatattttcaccctttgtaaggattgtctcttaactgttgattgtttcatttgctgtgcagaagctttttaatttgatatgatcccaattgcccatttttgctttggttgcctgtgcttgtagggtattactcaagaaatctttgcccacccaaacatcctaaagggtttccccaaagttttcttttagtagtttcatagtttgaggtcttagatttaactctttaagccattttgatctgatttttgtatatgcagacagataggagagtttcattctgctttcccaacacaatttgttgaagagactattctttctccaatatatgttctttgcacctttgtcaaaaatgagttaactgtagatgtacggatttatttctgggttctttattttatttcagtggtccatgtgtctgcctataccactctgttttggttaccatggctctgcagtataattttaagtctggtaatgtgattccttccattttgctctttctgttcaggatagctttggctattctgtgtattttgtggtttcatatacattttaggattttttttctatctatatgaagaatgtcattgatatttaataaggattgcattgaatatgtagattgctttgggtagcatgtacactttaacaacattgattcttccaatgcatgaacatgacatatcttttcattgtttgtgtgatctcttcagcttctttcaatgttttataatttttattgtatagatatttcacttctttggttaaattaatcttaggtatttattttatttggggctactgtaaatggaatactttcttgatttctttttcagtttatttgctgttggcatatagaaatgctactgattttgtatgctaattttatattctacaactttactgaatttgtttatcagttggagtctttaggttttttctaacataagattatatcaattgcaaacacgcataactttttccttaccaatttggatgtcctttatttccttctcttttcctattactctagctagttcagtggtgaaagtgtgcatccttgttgtattccagatcttacaagaaaggctttccatttatcttcatttagtataatactagctgtgagtctgtattatatggcttttcttaacgttgacgtatgtttcttctttacccaatttttagaggattcttatcatggaaggatgtagaattttatcaaatgatttctcagcatcagttgaaatgatcacatggtttttatccttcattctgttaatatgatgtattgcattgtttggtttgcatatattgaactattcttgcatccctttatttaatctttacatccttatatttattatatttataatcccatgtttatgaaggaaattcaatcaataattaatacccttcataaacagacagcatcaggcccagatgagttcacaggtgaattctactagacatttaaagaagaaattatgctattgttctatgacctcttttagaagatagaagcagtgaggttactccctaagtcatactctaagaccagcattactgtaataccaaaaccagagaagaaaatgacaagaacaggaaactaccagccaatatctctcatgaacacatatgcaaaaatcattaacaaaatattagcaaattggatccaacaatgtgcaaaaagaattacataccacaccaagtgggatttattgcatgtatatgaagatgatttagtgttaaaaaatcaattaatgtaattgaccacatcagcaggctaaagaagaaaaattacatggtcatgtcaatagatgcagaaaaagcatttgacaaaatccaatatgcagtctggtaaaaatggtcagcaaattaggaatagagggggacttcctaaatttaataaaaacatgtacaaaaactctattgctaacatcatacttaataatgcaaaactacaatctttcccactaagatcaggaacaaggcaagaacgtcccagctcaccactcttttttaccatcatactggatgttctcactaaggcagtaagacaacaaaaggaaacaaaagatataatgattggaaaggaagaaataaaactttgttcacagatgccatggtcatctatgtagaagatcaacaaaaacaacaataacaaactcctagaactaataaacaattataacaaggttgcaggatagaaggttaatatataaaagctaatcactttcctatatactagaaatgagtaagtggcatttgaagttaaaaacacaataccatttgcagtagcacccccaaaatgaactatataggtataaatttaacaaaatgtgtataagatctttatgaggaaaactacaaaattctgatgaaagaaatccaagaaataaataatggagagatatttcatgttcatgggtaagaaggctcaatattgtcaagatgtcagtctttcccaacttagtctatatattcaacaaaatcttaattgaaatccaaagttgttctgtggatatcgataaactgtttctttctttgttttttacttaaaaaatctgttttattgaggtgtaatttatatactataaaaagtacccatgtaagtgtacggttggatgagtttttcttttcactgacataatctttgcaaaagttggataagttttgcaaaaatataagttttgtaactatattatatgggtctatatttggcctttgaattgataaaggcaatataatggaagccaagatagttttttcaccaaatgatactataacaactgggcaaccacttgcaaaataacaataatctagacatagacttcatactcttcaaaagaaataactcaaaatggatcacatacacaaatgtaaaatgcaaaactatatactcctagatcatcagagaaagtctagatgatcttgagtttggcaatggcattttagatataacatcaaaagcacaatacataaaagaatgaattgattaaagtataataataaaaaataataatcataaaaaaaagaatgaattgaaaatccggacttcaattaaattaaaaactccatggccgggtgcggtggctcacacctgtaatcccagcactttgagaggccgaggtgggcggatcacctgaggtcgggagttcgagaccagcctgaccaacatggagaaacccagtctctactaaaaaatacaaaattagctgggcatgggtggcgcaagcctgtaatcccagctactcaggagggctgaggcaggagaatcacttgaacccaggaggcggaggttgccttgagcggagatcgcgccattgcactccagcctgggcgacaagaacgaaacttcgtctcaaaaaacaaaaaaacaaaacaaaacaaaacaaaaaatactcctggccgggcgcagtggctcatgcctgtaatcccagcactttgggaggctgaggcggtcggatcacgaggtcaggagatagcgaccagcctggctaacacggcaaaaccccgtttttactaaaaatagaaaaaattagccaggcgtggtggcgggcgcctatagtcccagctactcaggaggctgaggcaggagaatggcgtgaacccggaaggcggagcttgcagtgagccgagatcacgccactgcactccagcctgagcgacagagcaagactccgtctcaaacaaaacaaaaaacaaaacaaaacaaacaaaccaaaaaaaaaaaaaaacaaaaaaaaaaaacctcctgctctgcaaaagacattggcaagagaataagacaggccacagactgggagaaaatatttgcaaaataaatatttgataaaagagtgttgtccaacatacacaatgtactctgaacaataaaaaagaaacgatttatttagaaagaagcctaagacctggacagactcctcaacaaggaagatatgtagatggaaaaaagcacatgataatatgctccacgtaacagttcatcacagaaatacaaattaaaacaacaacgtgatgccactacatacctattagaatggccaaatccagaacaccaacaccaccaaatgctgggtaggatatggaccaacagaaagtctaattcaatactgggtgtaacgcaaaatggtacagctactttggaagacagtttggtagtttcttaaaaaactaaacgtactcttaccatatgatctagcaattgtgctccttggtattaacacttgtgtccgcataaaaacctgcacctagatgtttattacagcagctttatccataattatataatagacatatgatatattatatatatagtatctttattcaacttttaaactttgtataactgaagtaacacagtatttattttttctataagttgtttttgtcaacattatgtttcagagattaccctttttaatgtctatgtaggcctactgaatttatttccacttcacatagcatggattgcattcatacaaattcattaatttttgatagacatttagatggcttccaatctaaatttgaaaataaactactgctatgaacactattacatgtgtacacaggtggatgtgtgacaaagcaaggataaatgcagagagttaaattgcagaatcatagcatatgctcattttaaactgctaactgctgccatattgttctgtttaagattggccgttgtcctgcatatgagtgaacaacatgccacgtttggacaataacaaataataccaagtttgatcacttaccacagcattgctaattttatcagatttataagggaccgactttgtactttattgatcttttctattatattttttatttttaattattttctgctcttacatgtacttctaatatccttattgttgtcttttaagatacttttcatcttctaacacaaaatataatttatttcttgttatatttatattctgaattgctctactagaatttagctccactagagcataaattcttgcctgttctgttcatatattaattgcaaaccccagaacagtgtaggcacaaatatttgttaattaaatgtaaatatgttaatcttttattctaacatctttagtcttgttagtctttaaaaatttttaaactgggtgctcagctcattaatttcagcctttcttcttttctattataaatattaaatgctatatatttttcctaaatgtcatttaatgtattatttctataagtattacttgccatgaaaaagaaatctgtattatgtactttggtgctatatgaattaaccatttacttaattattttaaaaactgctcactaatctttgtaagaattaaagaatttcatttgaatttgcgagattgtgtttttaaaaaatttcttcctttctttttatatttattgcctcacatgttcaataatgaagacttttacctcatcaactcagttatcttgatatacaatttcttactgcaaaagcaaaataaattcttctttccctttaattactcatttttcaagtaaggtgttattttaatagctgttttaactattaacaattgagattttctgcgtttatttttaagtattatggaatcatagattttcactgattcagtgtgttttagtaggcttcaatcattccttttgatgctcaaattattacaactttgggcaatgatagagccttcagagtggctcctacatcctttcaatgtgactcaagactttgtaaaagttttcaggctttcaagcacaaaaatctaccctacactccccttgtttgttccttgcacctaacctagattgggcatttctccagggaagacctggcgctttttagtgaggaatggtatcaaacagcaaaactgaagtgctcattgctctgctagagcaacattgtttccgagccatttcagtggacagggatcacaggacacacacacacacacacacacacacacacacacacacacccttccttctatacaattatttttaatcatgagtgaaatttgatattttcagtttaatttcaataatacggtatttacatttattttctttgatattataactgtcttttctcttacactgaaaatctttattaaatcattgatgtgattacttattgttttaaccctcaatacaaggaaaatgattttaaaataccaaactgatataaatacactagtaaatactgttttggtaccctgttttcatccccttgacaaagccaatgtgacctctcatcagctcctgtagtgattggctgctgatgtctccgggggaacccttcctgcctaggaagttagctcgggctcccatccctgacagcaggccacagctgactgactgacataatagtacaaaaagttagcccccgaaaccgcaaaagccagtgccctttggtggggaggaggagaccactgagtcatggtttaagatccagagccctccactgaaggtcagatcaaggacagactacctgagatcagatccagtttcttttcatccctccctcacaagtctttcttcaagagcacttcctcaaaaattcacttgcaccaaatctcctgtgtcagattctgcttctaggaaaccctacataagacaactacgaacaatgtaactccagagggaggtttgagatttcatttttttttttgcccatagaatgcatctcattaagaatatataatcaaaatgccatattataaagtcactttaaatgctttctgtatgtgtgtatagtaccagacggatatgcaattgggtacacttgggttttatttttaatttaaaaaatgttttaataatttagattttttaagaatattgcacttatgacccaaaagtcgtaactaggaaaactaagaaaactcttatctgcccccaatagatgtcattaattatatttttctccaaaattatttattgtatctagttttcaaattgatttgcatagagttgatcgtattaaactttattgataatgttacattgatttatttttgttttaaatatttctcatttttctttttgatttcttctcaatgaatgaagtcttaccaaaatgtaaaagtttttaaatgtggaattcttttatacatttttttgctattgatacttattttaattgcattattgtcagtccacattatctatgtaatataattttcataaatgcttcatgtgtaattttataatgtataaatgtatattttctaatttaggggcccagggttctagctgcatgtattagatcaaacttgttagttattttgttctaatctgcacccctaatatttttgtttcatctgacaaatattgatggtggacttgacaattactacacacagttctgttcatttttgtttcctatgtattgacactaatgtactgtatacacagttttcacagtttttttattattatgtggggattctctttatgtttttccataaagtctattttgtctgatactagtataattatatcacatttatacctttattatgtatttttctatacatttactttcaatacttctgtgtccagatgcttaaatgagcctcttgtaaatgacacatagctgaaatttttagttgtagaattagtcaaataaatatttattgagattattcatatatgtgttattgcttctaccatctatcttttgctttctattcattgtgatttttaatgtttttttattcctgacactatcattatattttaaatttttcatttattctctactacttcaaaatcatatactcattttacttttattctaataaaacttcaccctaaacttttaccacccacatttacatttaaaattaatcattactgctaccctccacctaaacaatactaaaacctcaccttccttccatcttgcatggcactgatgagcaacttttaattccaccctgtttttgcctcataagttaggcattatttttgtctcatatgaataatatttatgggaatttgcctatcttctaggaccttctttcttcctgaaatacacttaggaagttccattggtggtaaatagtctagattttatttgtctgaaatgcttttgtttcatcattttaaataaaagtttaatcagatatatatctatacgtatatatttctgagttaaatcagcaagagagtaataggttcttgcttccattgttgctgttgacaaccacacttaatcaaacattcttttgttggcaagtttttctcttgactgcgttttaataacttcttttttttaatttaatatgttattattttactgtagtgctctggatgtgaaaatgtctaccattcattaagtttgaaaattcttcaagaacttttttctaatattgcctcctactcattttcttattctcacctccaaactctgatcagatgtgtatcaaaccttctcattctattctccatgcctattggcctttcatgttttctgaatatatagctctttgtgttgaattatgggtaatctcttcaaatacatcttccaaatcattgactgtctcttaaatctgtctaatctgctttttaacctatctattgatttcttgcttcaattatgtttttaatctctagaagttaaacatacctgtttattttaatattctcttccctttagtgatttttcatcccagtttttatttttatgaacattttaagggctgggtatagtggttcacacctgtaatcccatcactttgggaggccattgcaaaagggctgcttgagcccaggagttcaagacctacctgggtgatatagtgggacttcgtctctaaaaaagccttgaaaaatcagccaagtgtggtggtgcacaaccgtagtgtcagctacttggtaggctgaggtgggaagatcacctgagcccaggaggtgaaggttgcagtgaaccgagactgagcctctgcactccagcctgggtgacagagcaagttcctgtctcaaacaaacaaacaaacaaaactttttatgtaataattctaaaatctaaagttgctgattcttaaattgtgctgtttacatatttcctgttggctgtttttcatataattttttttccttttggatttggcaaatttttactatgggaaattattagaactatttagtcttaatctttggaaaacctgagggatctagttttaagataaattactttagaaaggaatgtttgaatttcccctgataagtcaggaagaatgcttgaacccattcagaattccctttcttatggtaaatttcttctcagggaattttaccttttcctaaaatcttagctcgatttgaatactccaagagaaataagaaaaaccaagagagaatacagtcacggaaaggagaatgttttgagaaaaagtcaggagttagtaatgtcaaaaactgctgaaaggcaagaaagataaatgccaagaagtctgtgtcatatatagtgatatctgtgaatttagccagaatagctaagagtcacgttatcatctgaaagccaatttgctaaaatttcatctttcctttatttatgaagttaagtttcactggatacaaaattcttcactgataattgttttgtttgaagaggctgaagatagggctccaatcccttctggcttgtgcggtttctgcttagaaatctgcgttaatatgattggtttttctttctaggttacctgatgcttttgcctcacagctcttaaaattatttcctttgtcttgactttagatacactaatgactatgtgcctaggtgattatctttttgtgatgaatttctcaggtgttttttgagcttcttatatttagatgtctagatctctagcaaagtcagggaagttttccttgactattccctcaaatatgttttccacaccttcagatttctcttcttcctcagaaataccaattattcttaggtttggttagttaacataatcccaaacttcttggatgctttgttcctttaaaaagtttttcttttctttgtcttcgctggattgggttaattcaaaaacctttctttctttctttctttctttctttctttcttttttttttttttttgagctctgaagttctttattctacttgttcaattctattgctgagactctccagtgcattttgcatttctctgagtgtgtcctttatttccagaagttgtgattgtgttttatttacattatttatttctctggagatttttctttcatatcctgtaacattttttaaatgtctttaagttggcattcacctttctttggtgcctcgttaagtaccttaataatacaccttctgaattctttttctggtgattcagcgatttcttcttggatccattgctggtgaacgagtgcgatcttttgggagtgttaaagaaacttgttttgttatattaccagaattctttttctggttccttcttgtttgggtacactatattagagggaagatctggggctcagtagctgctgttcagattgttttgtcccatggtgtgactccttcatgtggtgctctcccccctttccctaggaatgggacttcctgagagctgaactgcagtgattgttatttctctcctggatctaggctcccagcagagcctcctgggctcaaggatggtactgaggagtgtctgcaaagggttccgtgatgtgattggtcttcaggtctctcagccatggataccagcaccagccctggtggacgtagcaagggagtgaagtggactctgtgaaagaccttggttttatttttgtttagttttctggttttgtgtttgttggcttccagccaggaggtagagctttcaagacagcatcagcaacagtagtataggaaggatataggcttgccctagggtcacctggataagtttctcaggtagtgggcaggatcatagagctcccagaggattacgtcctttgtctttgcctaccagggtgggtagagaaagaccttcagatagggagcggattaagtgtgcctgaggtcaaactctccttgggcaagtcttgctgtggttactgtgggggttgctggtgtggatttcaggccaatggagttatgttccaaggcagattatggctaccactgctgcagcatacaagttgccaaggaagtgggcaaaagccagcagtgacaggcctcactcagctcccacgcagcaccaaagccccgactcactctcaccatgtcaccgtgcccacgcaacagcaccaagtttatttccaggcagccactaagcagggctgagaacttgccccaggctaccagcttcctcactgagaaagcaagcagggctctcaagtttcacacatccccacctgccaatggcttctgtgctgtgtctgcattcctggttcactctctcccccagattctgtccaggaaaacttcgcattcagtcaaaattgttacaaagttcagctggaagtttccttctccctgtagtctttccctaatttgactggcgagacacaggaccccagtgagacaaagtcttaagtggcttccctggggactgagagttcctacagggcttctctcaatgcttcctctagccctatattttcctcagctctctaaattcatctcagctccaggtaaggtcaaattctcccatgatctggaccttcaggttccccagtgaggatgtgtgtttggaggtggacatccctcttccacccattgggcactcacagttttttggctttctcacagaacctatagcctcaatctgcttccaccaaagggtctgtggattctcttggctttttgttgtgttcctgcagtagaccttggagcaaaagttcatgatatgagtttccatcaaaagttcatgatgtgagctcctgagtgggacccacaagttagttgtgcctgctgtctgccattttttcctgccaacctctcaaaattgcccttgtttgatgataggaatgagcagaagcattgtcatggtggagaaggaccctggtgaagctttcctgaatgtttctctgctaaagctttgactaactttctcatatcacttttacaataagcagatactattgttctttggctctccagaaagtcaataagcaaaatgacttgaacaccctgaaaaactgttgccatgacttttactcttgactggtccactttggctttctctggaccacttctacctcttgttagccattgttctgattgtgctttgtctttagaatcacactggtaaagccatattttatctcctgtggcaattcttcaagaaaatgcttcaggatcttgatcacacttgtttaaaatttccaataaaagccctgctcttgtctgcagctgatctgagtgcaatggttttggcacccatcaagtggaaaatatcctcaactttatttttttagtcagaattgtgtaagcagaaccagttgagaaatctatggtgttggctatagtatgtgctgttaatcatcaacccccttcaattagggcacaaacaagataattttttttccttacaaattgatgtgaatgatctgctggtatgagcttcatcatcaacactgtcttgtctcttcttaaaatgagttatcattgatgggcatttgggttggttccaagtctttgctattgtgaatagtgctgcaataaacatatgtgtgcatgtgtctttagagtagaatgatttataatcctttaggtatatacccagtaataggattgctgggtcaaatggtatttctggttctagatccttgaggaatcgccacactgtcttccacaatggttgaactaatttacactcccaccaacagtgtaaaatcgttcctatttctccacatcctctccagcatctgttgtttcctgactttttaatgatcaccattctaactggtgtgagatggtatctcattgtgattttgatttgcatttctctaatgacagtgatgatgagcttatttccatgtgttttttggccacatgcatgtcttcttttggccaggcacggtggctcacacttgcaatcccagaaatttgggaggctgaggagggcagatcacctgaggtcaggagttcaagaccagactggccaacatggtgaaaccctgtctctactaaaatacaaaaattagccgggcatggtggcatgtgcctgtaatcccagctactcgggaggcagagacaggagaattgcttggacctaggaggcataggttgcagtgagcccagttcatgccactgcactccaccctgggtgacagagcaagatactccatctccaaaaaaaaaaaaaaaaagtcctcttttgagtagtgtctgtttatatcatatcctttgcccactttttgatggggttgttttttcttgtaaatttatttaagttccttgtagataatggatatttgccctttgtcagattgataaattgcaaaaattttctcccattctgtaggttgcctattcactctgttgatagtttagtttcttttgctgagcagaagctctttagtttaattagatcccatttgtcaattttggcttttgaaatgccctccaatgatagactggataaagaaaatgtggcacatatacaccatggaatactatgcagccataaaaaaggatgagttcatgtcctttgcagggacacggatgaagctggaaaccatcattctcagcaaactgacacaggaacagaaaaccaaacaccacatattctcactcataagtgcaattgaacaatgagaacacatggacacagggagggaaacatcacacaccagggcctgttgggggttggaggctaggagaggaatagcattaagagaaatacctaatgtagatgatgagttgatgggtgcagcaaaccaccatggcacttgtatacctatgtaacaaacttgcacattctgcacacataacccagaacttaaagtataatttacgaaaaaaaaaaatatatatatacacaaattaaaaaaaagaattatctatttgtaaactgtggatttctttggagcattgtcctcataaactttttgtatagcattaatgatttcagcattcttccacccaagcttcactgcaaatttgttgtttgttcttgtgtttattttaccagaatttatgttgctctgataggggctcttttcaaactgatgtcttaacattctcattgcttcaaactagagcctgttcagacatattacaacaagttagtatgagtttattttggtgcaaaaaaattgaaatccatgcataggtttttttttaaaataatagcattttccatgaactttttaaagatccctctacctgttaaatggatggataaggcttcattgctccctgaagtgatcgtatctaaggaagtaagccccaaaatgaaaataaaaggctcgataacctttagctctgactcttgtctataattaatggtaaagaattgaaaaattctagcaatacctagttgtaaagataagaaagaggagatcaaaatgatcagtggccactcctcaatctgtaggctgctctttatagccaacatcagtggcaaaagtccaaatgattatgacttgctcataaattgcaggataaatttttttagaaagcaacaggacatgacagacactcctaatgaaaacgtaaataccttttaagcctatctgtaagagatgcttttaatgtagaaaaatatcatataatttttgatatatttgaactaattctaagcctttgtattacaagctccaaacacttaaacctatcaatcactctatttgctctttattatatagatccatagtgctctatgaaatatttagtgtttcaggaaaaagaaaacaattagaaaaataagacatttgccctaactattctaatttatattctgagacgaaaaaatatttcagaagaagttcaattggcatgaattctactatataaatataagatcaaagcacactctgtaaaattgaacaaaatctggtttcttaagtatatatgggcttctctttaaggtcacgttttcacttacagatgggctgacttgtgatggaaacaaaagtgaaaagacaaagaaagtagatggctatataaaaatgaatgcaataactttttgagctgcaactaaggagaaaggcaaaaaaatgattattgttagaagttaggagtccatttctagaaatagaaagcattacatttaaattagacacatacccaaaaaaaggagattattaaaagagcaaagaataataatagagagactagctccttgactaatgagaaattgtatagtggtatactgtaaagaagtgaatattgttttttttagaacataagctgattctaatatagcaaccacacttactatgaataaaatgtgtgcaggcatatgcacatacatagttaatgaacaacatttcaaataattctgggtatcttttttaattgaaatatttggagaatatgagagcaagtttggaattcacactaatgaaatgaaagagctcaaacatttaatgtttacttaaatatattttagggaaaaggtagataccatggaatacatttcttttaagtcataactctgtgaatatataaggtatacctcacacatggttatcaggtgctttttctttttctccttgtccacccttaaagccaccatttaatgttcttactaccttgactcctaaactttatgaaaaaaaaaaaaaacaccaaatcttctcctcttagtttctttatgtccttgtaatccagttttttactcccagaactctcttggaattgcattttgtaaggttgtctattgccccaataataagaaaatttagtagtcttttttaggagactttgagtctatgacgttacagacttacctgaaattctcttttctattgtccttgaagttctgaacactgcactccaatatatgccattctggcatattgattgttttgagttaaagaggaagtgggaagggggagagggagaaagaaaaaaaaagaatgagtgagagagaagaaagagagagaaagaaggaaggaaggaaggaaggaaggaaggaaggaaggaaggaaggaaggaaggaaggaaggcaggcaagcaagcaagcacactccaaccttcctaaaagcaggagataaaactcccatgtggaatgtcttctcccctccactggaagaaggaagaccttcttatcaccagagttgaagagtcgaggctgagagaaatctccaccaacaacctgtattaaactaacccttatcttcctagccacttctctgtaaacaactacctcagcccaagcccccttgctttgttacattttcacaatttaccactctttttccaaataagtatataagttgtcaactctaattgcagctttgtgtttttatttccttatgatggctccatgtcaggtaaaactgataataaatttgtacgctttgctctcctgttaatttgccttgtgtaaatttaattctcaggcccagctaaaaactctaagagggtaaaggtaaaattgtgccttccctacaaccttaacatgctgtcttgtctctaggctgccctcacacctcccaaaccctcctacttggttttatttttgggtttctctgttttctctttgccctcttcttccttattctacaaactattccttgatcatcacgtatgtaaagcaggaaaaataattttttctctacccttctgagttcttagctgggactctttttcacaaaaggcagattaataagaaacttgaaacaagcagaattttattaacatgtatatcttatatatatatatatataggtgatactcaggactaaaagactaattcttaaataggtggcttagaattcaggcttaaataacatcttcaactgaaaacaaagaaagaagagtgtggggcaggctagttataggaaacttatgacagataaaaactagttagtaaagttcattatgtagatttctctgatgccctctccaggatgacaaaggtctaaagtaatctcaggtagttaactttagtttttactggtagagaaggaaggagggacatcattgtaaatttatgtcttgcttttaggcaaataggaaaaagacagagagatctgtatatatctgcttcttctcagttgccttcagctcaaaaaatcctcatgccaaagtggaacattttggggtggcatattctgctaccctggacatatgcttgcataaatacaaatgccattgtttatatctttttaactctaaagacaaaagcaaagacaccagttgtatcagttgtcaaccttctcaactgtgatgtgcttaaatcatcacacagtagtctatttccaagaagtaaaagagaaatggcatttgaactactgacattatttttaagattaattcattgatttatggtttagcattaacccattgtattagtctgttctcacactgctaataaagacattctagagactggataatttataaaggaaagaagtttaattaactcacagttcagcatggctgggaaggcctcaggaagcttacaaacatggtggaaggggaagcaagctcatccttcttcacaggagagagaagaatgagaaccaagcaaagggggaagccccttctaagaccattaaatcttgtgagaacttactcactatcactagaatagcatggggaaaaccacccctatgactcaattacctccaacaggtcccttccaccacatgtgagattatgggaactacaattcaagatgagatttgggtgggggacacagccaaattatatcacccatgtatttcaaaactacacactttgatgtggtaactaaaagcttcaacaataaagtgatttgtgtttctttttctgtataaaatgttattttctgtgtggtgtttcctttgatataccttgtatagaaaactgagttgtcatgtggtaagtttaaaaaaaaatgtttctaatctagtactgaaatagatagaaatcagacacaaactttagataaaatgttacagtgtaggtgtggaaagggtgtgatacttttttccccgttgaaagggtcacagtccacactcctaaaacaaaagagaggttaacaagagaaaagcattatagatttattcaatcaaagttttacatgtcatgggagacttcagaaatgaagacttaaagattcagggaaaactgtctatttttatgttttgatttgatgtagaatgcacaaccatgtagaaagaagaacagactcaggcatggtggctcatggtcctagcaatggtcctagctatgcaggagtgggaggcaggagaatttgcttgagtccaggagttcaaggatggaatgagctatgttctcaccactgtactccagcctggtcaacagatggagactatctcaaaaataaaaaataaatatgattgaaccaaaaaagtaggacctaatggtaagagactgaatggggaaacccaacaagacctgtctgctcagattcttcttggcttctctgtgtggcatttcttcttcctaggtatagggtaagacctttctggagtaacagtcttatgtctacctttagacaaggtaagtcagagaatttctttattgctagctcttacacagaaaggcaagtgatagagtaatatttctagattttatggccagctgtgggagaaaagggttctggttcgttctggttctatgacctgtcttagggaagaggaatactaatttctatggcctgccttggggagaaaggaaagcaggagaaagaagggcagaagaaggttagaaagagactttccttctgaagttcttccagtgtccttcatgttcaaagtactcagcatgccaaatcactatatttgggggtgtcattttcagagctcccacacaaaaaacttaagaagtttgaagtttaagtataatttaatgttatttatattctcattcaaattttaatatagtcattgtgaggaatagtaccatttataaatatgttatagttccaacaaatttaatgatacctatgctgaaaggttttatgagtgtaacaaatatgtatgattagttcataaattgactcttgttttatttgtataatataaattttagttaaagtcatactgaagtgaactcacagtctgcaataggaaaggtcgctgggtaagaatgcttaaggaatggaaatcgctatgaattttgagatcatgctagttcatctcgaacctggtgaattctattaagatgagaaataatgtatagttcttctgtaatgagcacatctaactgtaagaaattaaatctgatgaccaaaaaagggagcaatcagtgtgcatctctgatgtttgtgtgcaggtaaattgccttgcgttaaactgaatttggtagctgaagcaattatttctctataatattttcccttcagagagtaactgcaaatgatacaagtagcaaaccaacaaccaaaaaaatgacctaaacgttttattatcaataaagtgctacaactgtgaaggtaactgaatagaaaaccaacaatcaaaaggaaaaaggcataacatgttttattattgatataatttgaggcatacttataatgatactttgaattccttgaattgaagaaaatcgaaaactgcatagtaaccctgcctacttatatgcactgggaatgttactacccttgtgattcacttaccatatacagcagtgtaaaaagagggtttccctactgtccttttcagagagctccaccctgattactttcagtgccacccatgtgtaagttcaaggctttccatttcccactagcttcctctaagttttcagagttccaacctcaatttcaggcatttaggtgtctccttggcaactgaagtggacactgtcctcaaaggaaccttggaatgcactgacgtgtgtcagttgtgctgcatagtctgcgggcagcctctgcacctctcagcaaaagtcacgtacggaccctgctccaacatggccccctggcactaagacagagctcactgttggagggagtggaggctggaaaataaacaaaagctgactctgctcctgcatccccagctaccctgcagagcagtgtccttgcccggggactgctttggcctctctccatcaccactacttcttctacccaatctacatgggtggttgcagtctttggattatttggaagtcaaggtcctggtccctaatctgttcttttcaatctattgtttatgaccacaacattatgatcttagcccttcatacattaacaccccagaaatactaaagggcatctcttaaggatcaaaaaccaggctattttttccattaagagctctgaaagtgtattttgatatacataaaagttaaggtttgtcttctttgttcttgtgattgactgtggtgccattttcttgaaacaactgaggaggaaggacctggctgtcttcagagtataaggaatgatcagggctttggagggggaagacagcaagtaatgtgagagagtgccgcattatagctaaaagtaaacactgcacaggattacatcccagctccaccactaactagctatgctaccatggacaaattaaattacctcactgtgacttacttttctcaccaatattagtttctcatgactgctttaacaaatcatcacaaaattgatagcttaaacctcagaaatttattctctcactgttctgaaggccagaagtctgaaatcagcttcactgagctgaattcaaggtcttggcagggccaaactctctctgaagctttagaggagaattcttcctggcgtcttcccacttttggtggctggcagcaatccttgctggctgccacatcccagtctctgcttctatggtcacattgcctttgcctcttctaccttgtgtctaatctctctctgcctccctcttataagaatatacacgattgcatttagggtccactcagatagtccatgatcatctccccatctcatgatcctaatttaatcacatctgctcagtcctttattgccttataaggtaaaattcacaggttccaaggattagaagctaagtatcattggtggaggcaattattcagcctgctataaattagcttgatcattaaagtgcctacatgaacattcaagaatataatatgtgaaattcacttagaacaacatctaccatgccataaaagcattcaacaatatttatcctatgatagtgatattcatgatgttgcagcaacaagaaaatgcagacaaaagtttcaaggtagaaattatttttaaataaatgtatatggaagatctcatgtctggattttttaaatatatgttgcccttaaaatgttaatagtaatcaaaggattatctccccattgaataactataacccaatagtttaggcatataatacatgcagccacttggggctttgtcttttgttacttttcacttgaaattgaaatcactgtagcaatttcatctaccctgaattcttcctaaggtcaaagtcaaagacgtgatgtaatacaatttcctcattttgctcttttgtctcctacccacctaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctgtaagtgtcacttttgtgtcattatctaatcagaactcttctttgctggcatttttttctccacatctacctgatagaaaatgccacagataagcacacagagaacatccaacagaaatagaagcaattatggtaccactagttatacctgatggcaggttacaccttttttctcttggtatctagacattttgtatttagaagcagttagtgactatcatttctaacttaagatacagtccacactattcaatgaaacagtatcaccatccaccagaagtggtcccttttcacttaactacctcaggctcttctactaatgcattcttcgactaatgcacctcagttccagagaaagaaggatggaaacacccacagccaatggcttgcttggtctaataaacctgacatttcatttattccttaaaaaacaaatcccactggagactcttcgcattttagtgcctaaaatctggcatcagaatacaattccatatacagaaacgagaaggaaatgatgtgattagtccacagaaggttaatgtgccagggattccttaaaagtaattttattccaccagactgccccactcacagtttgaccacaatgaagagtggaattaatttaaggatgtataacatcatcaagaacaatgttcctttcagacccgaaaaggacttatcatttagtttgagtcaatatccaataaagccattctcaacccactcttcacataaaccaaccatctcagttctgttcaactgagcttagcttagtaggaataagagacacagactcaatagtaaataaatagataacacaaatatgagtggttatgtcaatgaagaaggtaccttggaattaattctagaaaatctttaagaaatccttgctatcacttactgtattcattatctactactatgtaacaaaccactccaaaatgcaattgcttaaaacaatattaatttattgcttagagttctgtgcattaggaatttgggcacatctcagccaggtagttcttctgctttatgtggtattagataaggtcacccatataaactccacacaatattggctagggtcactgatgtgagcctgtcaatcttgagctttgctgggactggaatgtccaaagaggcctcactcacatctctggtgctggctgttggccccattctcctgcacatgcacatggcttctctttctgggaaaaaaaaaaaattgaccgattctcaggcaacaaggtagctgaataataaaaggtgaagtcaacacgcaagcatttgtcaagcctctacgtgagtaatgcttgctattgcttcgttggctacagcaaatctatgactcagcctgtagttaatgtgagagggggctatcaaaaggtgagaagacaaggaggcatggctcttctagggccaccagtgtagtgatcttacctcatttactcaatctactatttactattcttgaatttgcatgtctcaagttttaaaatgatgtttcagagcacatttgaattacaatcttctagaaagactaaagatctgaataaaacaaaaatcaaagatcttttagagttctagttcaaagaaaggcaaatttgatactgaactcaaagaaagggattgcaccttgatgggaaggaatttcttttcagacatgcaacagggaatctgatcattctaggtttctacaatcatatttacaggtataaatataatatacagtcacttgccaatatatgcttatcagtcttttcttattctctgatcctttgttaatgtagccattacatacaaaattgtggcaaaatatatatgtttaaatttttgtcttgaaaaaatgtggaggcaaattttcttttaaaaatgtgtaggctattttaagttataaaagaactctattatcctatactagatactaacagtttttattaatcatcttgaacaatgaaaatgtttttctaaaatctttcatatgtggacagattactctcctttaaaaaattatcgtagcaaattgctaaaccattttgtggaatgatagcatggccagacctttacaatgcagcaggacgcttggaatccaaaagtcatttccccatagtaactccaattcaaatgaacagcaagtatttatttgataaggagctggagtgtcacataaaaacattccctaaaggacaatctaaataaactgtatgtgttgccacctaaaagtacttttcccttataaatgaatttctccacgtgttattttagtaaacattcaaagctaccaccctgcacatatagctctatactcttcagcctttgagaaataaaagattagttgctgctcactgacttttcttggaacacacctgcaggacaagatttttaatattttatctttttatattaaagtaaaatatatcaagaaattgtttcacaactatccaattatgtattagtggtgtgactgatttttgtatgggtttcttgtgtttgtcacttattttatatgattatgtatacttattagaattgtgcttttttcttttcttttttttttttttttttttaagacggagttttgctcttgttgcccaggctggagcgtaatggcgtgatctcggttcactgcaacctccgcttcccaggttcaagtgattctcctgcctcagcctcccgagtagctgggactacaggtgcacgccgccacgtccagctaattttttgtattttcagtaaagacggatttcaccatttggccaggctgttcttgaactcctgacctcaggtgatccacccgcctcggtctccgaaagtggtaggattacaggtgtgagccaccaagcctggccagaattgtgcttcttaaacatttgattcaggagaatccttcttgttgcccaatatgtgctgaaatgtttaccttattactgaaaaacaggggtgatggtcgcaatatttaacagcccgaggggcgtgggcaacaaccaagcaaatagaggggcagcttcgagaaagggcaggggctcggcggctctgctgcagggaattacccctttcattactggaggcatagaaatatctagaataacctaggggagggactgacggaggtggccaggaaggtgatttcggggagcgactctccaccgaatgagagggaagtatttgagtgctttgaccaccgacacatctcctccatgaatacagcctgagcaagtgcctcgcgtgagtggagcttggaactggaagaaaagtcacctctgtcataagcattccacagactgtgtacatgcttgacggaaacgaatacaattaactggactcagaaaggcgaagacgggcggggttccttaccaggctgttgcttggggctcagggagcatccccactctccaccgcctgtgccttgcttggcgcagaggcccccagcttctgccggcgcctctgtccctgggaggcggcggggggtgccacgtgcatcctcccccggctctcaggctgagaacgacagggagagtgctaggcacagagaaggttcttgttgtcctaaagtcaccaaatcctgaagaagagttcctgcaaattgtcagcaacaccaaggtgaaaatcagcgcggaatccatagaaaggttgtggatggtattgtgggggagcagcaaaatgcaatccatgctggagtggagaagtcaaagacaagcagactccggccctgggatggtgagtcccccgctctgtgcccactgcccgtctctgttcatatgctcatcacttctcacctgaagctggccagtaacctcctaaataatcttccccaccaagttttgccctacacttcatgcatgcctcctgctccctgtaagatgatcacaaagcgcaaatcttatcagtcacgttccttccgatcacccttcagtgattctcatcaccttcaggatgaaatctgaattccctactgtgcaagggaggccctcgtgacctgcgccagcctaactcccaccctccccttctggcatccagcaaaagaacccttcctgtgccatcctcaggcagcggcctgcatggaatgggttctcccccaagtcccttctccctcctaccccacctgggctccttatccacctagctcctagcagacatcttcccccaaaacacctcaggatatgttaatttaattttgttaagtagttaatacatatacttggttcgaaaacatacaaatgtatacattaaaacctctgtccggcgtttgggccccatatgcctggttctcccatctctgtttccaacaggcatccagttttactcttttttatttatttttgtacatgagtccaaagtgcctttatgcaagtgcaagaaaatgtgactatatattcttatttgctccccacacaagctaacgtatgatatgcactcttctgagcccttctttttattcttatgtattttgtaactatttccttatcagtactcaatgtatcattgtttatttaatactcttctattaaatatattgatggacatttggactctatccaaatatgaaaataacttcagatgtatacataacacatctatgtgtgcatatatatactatagcgagtataatatatagatagtatgtgttacatattataatcatatgtcatatagctattatacacaatgttatactaaaaaactgtgtgtgtgtgtgtgtgtgtgtgtgtatgtgttactgagagcatttcctagtcctctcccactcactccctcaggctgtactagatgccctgacacctgagcacactataatcattgagtttctattctatctactggaaggaaagcttcttgcaggatagaattgtgttcttttttcacttgttcatgtctgtggtttcagcaactaatgcagtgatggcacataaatatttgttgaatgaataaatgatcaacaaacaagagactctgaagtcccaaaagggtgaacacaaaaggaatctattgagcaaaaaccagcaggagtgaatgcatggacaagatgtaggagccagagtgaagatgcccttcatctgggaagttaagagaatgtcagtaaaatgttctgtgcagggcatagcacagaagcattcaatacatactagtttcacattgctattactaatgttattattacactgccctgtgcttgtccttatcctatttaggctggtccgtcttttgaaggccaaagggctccattctggtggcactccatctactgaattctcatttctttaatcccacaccagacaactgtttcctgcatgagaacataattcctgtgatcttcataggacacggcaatcataaatccctattaggagggctgaacttttacttaatatgtatgtattttcctcaatcttgtttcccagaattctttcctacctgtgcctcacaagagcatttgttggactgaatatattctcatattttcatgaaaaaatatcagaattattacagtggaacaaagatttcagtagcctgtcaacagccagtagtgtgctcctaaaagctactctttaacttcttatttatctcccattaactagaactgtactgagtgcagagtggccactctttcatagttattgagtaaattgttgtatacattttctggattttagatttacaaaacccaaagtatgtaaaattttttttaattggaagtaatttaatgaggctatgtcttgattttattttataccatttgataaaaactatagagaaaacatactgtcaaattatttctgatgcagacgcaatttgtttggattggtaaggatacctagctacaggaaaagggacagtcaatctgctccaagattgtaactctatctttgaatttgttcttccgcatgttctttattttgagagttattttaataagtttagactaccttagttgctttgcttccagtggggggatttcaaaacagtttctggtgaaaattaaaaactatgtctagttgaattctaagcactgtattttaggcatttttaaattacattcttactctgggaatttaataccacagatttaaagaggatgcacacacacacacacacacacacacgcacgcacgcacagtatagcatttcctttttctgctagagaatgtgaataaagtatttctgcttgaaataatctctattatcaattaatgtcatcctacagtgctgtattttactcatttagcacccgaacatctgaaacatgaaagcttacaaaactgaaatttaaaagtaattttaatatttgtatcacatgtggcaaagaaagggtcattattcataatacacaatgagatcatttaaattagtactaaaaccatgaaaatttagtaattaattcaatgaacaatatgaacaaatgtgttcacataagggaaaaacatccaaattgtaaacagtttggtataaaatataattattgatactaacctgatgtatgcaagttaactttgaaaaaattattttcactaatttagcaatttgtaaagataatgttaaatagaattgtaattcacttattggtagaagcagtctttgtctcaaagactattaaaatgcccataacttttggtcttgtaaccccactcaatgggctttcttctaagaaaataattcaacagaaagaaacagctacctgcattatgttcatttcagtgttatttataacagcaaatctggatatgtataaatatatgcaattaaagacatggtataacaatttatagtacatcaacttgatgaatagaaagtaataactatgttaattttaagaccatatataaaacatgaaacagttttttatgattcaagtacataatccaggaagaaagttcagatacaaaaagatttagaattatggatatgccttcccaaaaaaatgtttttacacattgtatgatattttaaataatactatttaattatcatatttgtatatttgatttgtatagaaaatcagaagagatgttatagttgcttttcttaaattatcaaccaatcctaaatctcataacttttatttgatcatttagaggcactcataaatcttagttactataaaatatttcattttagtggactgctcagttctggggttaataagtcaataatatccaatttaagtccctttttaattttcagtgttagttatttactggtaaacatggattcatatgctcatgttgattagtgcacacacacacacacacacacacatgcacacatataaaggagctcatttttataactagtagaaaaatcctaatctccaaacttggaaaagagttttaaaactcaccttattgatttctctttgcagctaattttacacatatattgtcttgaatcctcactgtcaatatattctccctcatatctgataggtgacaagtcacattctttaacaaacctttggaggttgtcaccatggtcggagctggggtcctatgagaattgttttttcatcatccctatgccttttgcattgtatctctctgttcacatcaacatttgtcactgttctctgcctttcatatcggacacattcagcttaatgataaattaaaacttaatagagaagggtaaaaagtaatattagaccacaaggtatcctgtagaatctttgttctccaaaggctgtatagctatctgttcatatgcttatagaataaattgcacaatgtcagagtagacaatactactgttgcttcagtaacatgctcacagagtgcaagaatgtaagtcaaaagacaggtgaaactgaacttttgaaatatatcccaattgcttttaattgtacctctccaaaaatgtaaatatagttaaaagatttttttaaatttctgtgttaacatttgcatttatttaacaaactcagcatgctcttggagctgatctctgtgcttttcaaatatgaactcacttaattctcaaaatgacccatgagggtagtgttattatagtcattttatatgtgtgaaaactgagacacatggagaagttaaaaaatgtgcccaagatcccacagcttgtgagtgaaggtggacctcaaaccctggcagacaattcctggtcatgtgagaaaagaggacttctccttgcaacaccttgcagggttcgggggtaaactctgtcagatccataaagctatgaatctcctgttaggctgatgggatttaattgcagctccactattagaaagtaaaaataaaagtacaattatgtctaatagttaaaagattggcaaatagttaaaaatgtttcctttcactcttgaaaacatctctcaacagcctttctgatcattgttgtttattttttaaatggattatttcaacatttgtcaaatgctaaatatattggactctttttttttctcttttgcttgctagcgctttccagggtctagtaagaggaaagaaatcatgaccaacctctcctgtcccaaaagcctcccaggattacccttttaccagaaaatctatttttatataaaatagatggcttctgctcataccaaattttgagctgcttctaagtgctagatagaactattaaagatttagactgacttactcactatacaccatctctggtctctatattcagttccatgctcagaaaagtaaagcaacagtttatctaaagttccactcacccaaggaatcatttattggatcatcacaatattgagaggggtttatggttgtgggagaatttccatgccaaaaatattcaaagggctttggcagaaacatttgtgttcagaagccagggtacacctggtcagtcaaattgttggggcctggaactgtccatttagtgagctgtgattttaaatcacttcattctttgtatttgtgtctatgcagtatactctcttggtgaaatgtgtatacatttttgtcagacttactgaaatatgattcacataccatacaattcatcattttaaagtgtacaattcaatagctttcagtctactcacagatatgtgcaaccatcaccatggtcaattttaagacatatttatcaccttggaaagaaagcaccaccccttagctatcacaacctgtgcattcttctccccagctctaagaaactactaatctaatttctgtctctatagacttgcctctactggatatgtcatataaatgtggtctttcgtgtttggcttctttcacttagcacatatttttaaggttcacccatgtagcatgtatcagaacttccttttttatggctgaataatattctatcatacatttactcttaatatctctgcctgttacagatatatgtataatatttagcaaaattttctgaactaaaatttaaatttagttagccttcaccttcccactgataaattctgagaggaatttaggcaatccactgtatattttatctacataacgtcatatgttcatcttttggaaacatctgcgttacagatagcaactgacagctcttacacggatgcctggtcttatataaatccaatattatggttatctatcttttgtccacagcatctatgggttttaacaatttaaagcatgtgaacatttaaagcttatattcctcttataccataacactctccataacagtatgcatatgattagtattttttctatatgccaatcagttatcccaaccacaaattttatgccatcgctaaacaacagaattcagtctcttgagccctgatgctcatgattatcccagacagacatgtttgtgcatcttcataaattattactgccttactagtttcaaataatctccaaatattgattattaaatgcaaacatgagttatgacatttggtaaacttaaatattgtttcatcagagaaatgaaaaacttaattagaaatcgtatctagtacaaaagccattaacatagaaaatctgagatccgtttaataattaatcgagccaacatggtgacttagggcttatggaaatattagaggcaagaaagctaattttattggtgcattacttgggataatttaatgtcattcagagggtggcagatttttcacttttagccttaggttagagtaactattagattttaaaaagtagcttttcataataacgagagttcattcaaatagatttccatgtcacttgaaattaccaatttgtataaatttcattaataaaattttatatcactttttgtaatctttctaaatgaaaacaagctgtttcattcattcagcgaaacatattcagaagcccctactctgtaagagcactatgctgagagctcagagacgcaaggatggagatcaactaaacaaggttgaattgacgtggtccttcctgctgtaccttccagccggccgtcaaagtgccataacttaggacagaaaatgagagttctaaacttaatttctcagtgccatgagaactcatagaaagaagtagtgttcagaaaagttgtgatatttaacttccatctaaggcgttcactcttggatgggaagaagggaaaaggaattctatacagaaggaacagcattagcaaataaataaaaataagaagtcagaggaataatgagtgcagtgccctttggcttgagcaaagtgtttatgaacagaagtagtggcttaaagctggaaagaaaggttgaagataatgatgaaggggcttgaatgccaagtgaaggccttgggcctttgcagtaagtcaaataaggaactatgtttcagtttgtaaacaggtgacatatatggagtcctgaagtaaggaggctattctgaatggcatgtgcagggtggatcagatatgcagaaacaagtattaggatattcctagaaagcttggacccattctccccagagtgccctggaaatacctgtcgcagaaattcaacctcgaggaggacttcacagtgacataagtttgactggcatcatgttataccacttcttggagattcactatgtgaattaacacattaaaattcctgagaaactttgctgttaaaaaacaaaacaaaaaaaactcacggaaaacaaagtgagagactctgccagattaaaggagactgaggaaacacgacaactaaataaaacttgtgaccctagaccaaaaaacagacattaatgagacaactgttgaaagttgtataaggtctgtggattagataacagtattgtgtcaatgttaatttcctggtttttataatcatactgtggctgtataagatgctaacatttgaggaatatgggtgaaggatatacaaaaattcattgcattattttttcaaatttttggtaagtctgaaattacttcaaaattaaactttaaaaatatttttataattaaaagtataactgcatttccaatcaattatctaagataaacacttttggaaatactcccaggaaagacaggggaatttatatccacagagcagctgggagaaagagctgggttgacagagtaaatgagttcagagctgggttgacagagtaaatgagttcagatgtggacacatgatgaatcttggcaccattcttgcccttaacatattttaggtacatatacatgttttaaacctagttacctacttgagataatgaaatcccctctcttgctctttcagtcagaatggtccctattgcaatgactgactgggaaagggaaattagagacagaattatccaaataattcacaagaatcccaatatgaatttttgagaacatggtttatttcatatctccacattattcagaagtaaacaataaacttgggattcttcacttaatatatggtccctggagattctcaaatggttcctcaaaccctaacactctagtattatcagtaaagacatagttaatcacactcttttttctataacctgtaaaacaatgaaaacacaaagtaatcttttaaaaattacattctcttaaccataaaacaataaccacatcaaaattattgtctgaattttagttttttatataaatggatttttggtgaaaacttatttaatatgataccttactaatttaattacatagaaccttcatggatgggttgttctggagatctaaataaaggattagtcttgagtgtgaaaacttgctaaattttaacaatatttaatttagtaatggtagaaatcaattcaatgatttgtaatggtagaaatcaattcaattctccatttcttcatcaatggagtaataggattagaaatgtgcctaagtaagatgaattatgtagcagttgcagactatatttcagggaagatttagagtcagaacagtcctgcagataggtgggggcttataaagcctgagctagaatagcatgaagaatgtggaactagagagacttatcagacggacatcaaatcatgagaacatggtcattaattggataagacagcaatttaaagaaaaatcccaaagataatactcagattttgagcctaggtgacaagtgaaattgcagtaatgctgcagaaagagggaaataatgattagaaagtacataggcatgggcaaggacttcatgtctaaaacaccaaagcaatggcaacaaaagccaaaattgacaaatgggatctaattaaactaaagaggttctgcacagcaaaagaaactaccatcagagtgaacaggcaacctacaaaatgggagaaaatttttgcaatctactcatctgacacagggctgatacccagaatctacatagaactcaaacaaatttacaaatttacaagaaaaaaacaaacaaccccatcaacaagtgggtgaaggatatgaacagatacttctcaaaagaagacatttatgcagccaatagacacatgaaagaatgctcatcatcactggccatcagagaaatgcaaatcaaaaccacaatgagataccatctcatgccacttagaatggcgatcattaaaaagtcaggaaacaacagatgctggagatgatgtggagtaataggaacacttttacactgttggtgagactgtaaactagttcaaccattgtggaagtcagtgtggcgattcctcagggatctagaactagaaataccatttgacccagcaatcccattactgggtatatacccaaaggattataaatcatgctactataaagacacatgcacgtgtatgtttattgcagcactattcacaatagcaaagacttggaaccaactcaaatggccaacaatgatagactggattaagaaaatgtggcacatatacaccatggaataccatgcagccataaaatatgatgaattcatgtcctttgtagggacatggatgaagctggaaaccatcattctcagcaaactatcgcaaggacaaaaaaccaaacaccacatgttctcactcataggttggaattgaacaatgagaacacatggacacaggaaggggaacatcacacactggggcctgttgtggtgtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtataatttaaaaaaaggcactgggaggtaaactttagtcatttcatttaatctatcacataattaaaaaatagtttaattttaatttaaggaagagagtcaaagaattattcctggcagtcaggaaccttaacaaatcctggggtacaggaagcctctgcacctgtcggcaaggtggggagttctctcaacgggtaacgtcaggtattgcttagcactttacatctactgcatcctacttttgcttacttttgatttaccttttctatttctcctagtaggtttgtcctagaaggattttttaaaattttttaatttttcttttctgtttttttaccaccttgccttggacataacaggctcacagtgtatactgcataattactagcatatgagacatttatgtataggtaagcaaaactaaatgaactaattgtagagagtcaaaagtcaggtggaggaaggaaaactgtgctgcaaagtaatgacagcatgtgttgtgtgctctgtaatttactttaaataatgttctgtgtatgcatactgggtttgctgcttatcctggggaggtgggggaggacgggggtggattggtcagttgtgctcagctcacacttagagtatgcgaatcagaagggtggttcacagctgaaggactctaaacaaaagcccacatgtcagagacagcttctaaaagcttttagcatccactccctgatcaacaccaagaagtgtttacttagtatattgagtatcagaaacgatgttatcttggtcagatgaatggatctcaagttaaatgaattgactggatgtattcttcaggcattcctagttgctttgccttcacagagcatctgaatgcagtgagcttctggccctatgctttgttcagataattgaggattccattgcctgactccagttggaagtatggctgcatcttctattagaatattgtcagaagcagctcttcatattgccgaaaagaacagacagctgggactttagcaagcttgcagaataggttttgtaactgcttttatgctgcttgctaataaatatcggtatgtgttaagacagagtttatattgagacttacttgatttctggtagctaggttgtgggagagaaacaatttggccctttacttcctctagatatctactccccccaaaaaagatgttatgattgtaaataatcaaattagtttagttaatatttatcagaatagcctaggcagacttctcttaggaagtagcattgctggacatggtagctcacgcctgtaatcccagcactttgggaggctgaggcgggtggatcacctgaggtcaggagttccagactagcctggccaacatggtgaaatcccgtctctactaaaaatataaaaattagccaggcatggtggtgggcacctgtaatcccagctacctgggaggctgaggcagaagaatagctggaacccaggaggtggaagttgcagtgagccaagataaggccagtgcagtccagcctgggcaacaagagcaaaactctgtctcaaaaaaaaaaaacaaaaaacaaaaagaaacatggcatttgagctgaaatgaactcatttgaatactggggctaagaatattccaagggaaacaaaaattcatatgggtagaacttagcaagtaaagaaaagagtgatggaagatgaaattagagaagtaagtagatgttaaagaagatgtgacacacaatttaagacattaggatggtgtcaccatattttaaccagaagaatggcatattctaaatttaggaaagcaactctggaactactcaagagaatggattggagagaacaaggctatcacagtagaccacatgacagaagatggtagattggctttggtggtagcagcagaaatagaaatgcctagacaacagttcttgcaggaaaagaggaagtggtatgttaggtaaaggaaaaaagaggatgaggcttaggttttggatctgagcaacaggatagatgatactgctgcttactgagatgacagagttgagagattttgctccactggtagcttgtatcttttttaaacttgaataaaaagtacagtacaaacacagactaaaaaaaaaattcaataattagagaaatctttctagatctatcaaacaacttatataggctgggcacagtggctcacacctgtaatcccagcacttcggaggccaaggcaggcagatcacgaggtcaggagatcgaggccatcctggctaatatggtgaaaccccatctctactaaaaatacaaaaactagccgggcatggtggcgggcgcctgtagtcccagctactcaggaggctaaggcaggagaatggcgtgaacccaggaggcggagcttgcagtgaaccgagatcgaggcactgaactccagcctgggcaacaagtgcgagactccgtctcaaaaaaaaaaaaaaaaaaaaaaaaaaaaaaaaaaaaaaaacttatatagtcagcctaaaaagaagtatcatctagaaacagaaagtatgccttctcagattggaaaacctggctactccagtggttcggaattgattgtcatttcataatggcttaaagcaattagtgtgtatcagcatttacctttgactaaaaataaaactgctaacaagaaagctacagggaagtggtattctttatttaaattgattaatgtaaacagctctttcatttaaaattgatttacataaattcaagaaaatatttgcaatacacaattattacttagtaacaaagataatcaggaagtcctgcagacaatgaaacgtgaacaattaaaatattcaggatacacaaagcttttaattaatgagctaaactaatccaaataagcagggaactgtgttgtaaggcttggctatcatggattttgaagtcaatgattacaagaagaagaatcacagctactgttaagagttaacgaaagaggaaagaaatatgaaaagcagctcaacagtcaaagacaggtttattttggagaataaacctgagaggggcttctggccgatttcagtcaggcacattctctcttacaggctaagagtatttaagggttcagggcaagaaaacttatcacaggcttggaatgtgtctgtgtgaaggagaagtttattgaggggttgtaatgtctctggtcagaggggaggttcgggctgacatctctctggttggggaggttatatcaggctggcatgtctctggttagggaggggtttaccttaggtttggaatgtttccagttggagatgtcatttgtggtttatgattatgccgaccttagccatttggctgatgccctttgggttggatttagatggtttttgatcaagaggaactttaaaatggcagtgcctgtccaagatggtgatgttcctgctctgtcagctaccctgtactgaacatattccatgtgcctggtatctttctttgaagtactattttgcagaatcttcttgagaataatgtgaggtaggctttattatttctatatatgaagaaactgggacataaagaaaataagtattttgttcaaggtcctgtggccagtgttggggagagggcattaatcttggttctgatgtatctcaacactgctgtacttactgaggttactttgttagtacatagaataaaaggtaatatacaaataagtatttttttttgagacagagccttgctctgttgcccaggctggagtgcagtggcatgattatagtcactccagccttgaactcctgggctcaagcaatcctcccaccttaccttcctaaatagctagaactacaagcgtgtgccaccatacctggctagtattttcattttttgtagatacaaggtctcaatatgttccccaggcttgaaataagtgcattttaaaatacatgcgttggaaagatattagagttataaagagtcaatttgcaaatttcgtctgcttgacaatgtcatacaggtcaaaatcctcaaatcatgagatttatgtgtcctacatgtactggacaaagaaaacaaattcttttcaagctattctcattaatggaattaactatcagaaggaaaatccaattatcagataattttttaggtggggctttggaagattattctgtgcttacatgtgaacatgaaattatgtcaggttctctaggcgtggtggctcacgcctgtagtcccagtgctttgggaggccaaggcgggcagatcacgaggtcaggagctcgagtccagtctggccaatatagtgaaacctcgtctgtactaaagataccaaacaaaattagctgtatgtggtggtgtgtgcctgtaatcccagctactcaggaggctgaggaagtagaatcgtgtgaacccgggaggcggaggttgcagtgagctgagatcatgccattgcactccagcctgggtgatggtgtgagactccatctcaaaaaaaaaaaaaaaaaaaagaaaagaaaagaaaagaaaagaaattatgtcagattcaggtactggatgaaaaacaaatacggaaatcagagcatgagtgtgcaaatcatagaaagatttcattctcttatttctagaaccccttctcaacctggctagtacttccttcagcccctctaactttcagattgatggaaaggacctgcctaagcagaattcacctgcccctaatctagaaaggtgctctttcttgagcagatgtggtaaattcagtttttatcttctttccttaccactgagtcagaatttatatttgtataggagctagggtataagaaaggatgagtcaacaataatccaatacctttttatataagaagttaattacattaccttggttaatcataaaatctgtcttgatgttgcagatgattctattagatttaattgaataaaagaaagctttaaatcatattcgagtaaatatgtaccaggtataaattgtcaatatataactataattctgtatgtgtgtatgcatatataattactataaatgaatttttttcatctattaaactcagtattttatattccacttcagtacaagactttctataagattagtattcatattcaattaatatttcattataattttaaaaatatactttaaaaatacaattaaaattttatcaaatcaagccagaatatttattgctgagttgttttgatgctactttgcaaattacttgaatctttcttgcttgctttatttccattatagtcatcaacatcaagtattgattgatttacctttggcctagcactaaaccgggtagattccgtatctcaatataacagatataaaacatgttgacacagtcctatgctgatgattattggttattagaataacacagaggaaaagagaaaaaattatctgacaactattagtggaggcatataatagattttatgattaatcaagtaacgtaataactactttattaactcatttgatgttcctagcaatgttattattagctccatttcacaaataagaaaactaaggcaagaaaatgctattcggcttgcctagaatcatacaccaagcaagtggcagaactgagatttgaaaccagtactctggctccaccaggtgtctgctaaacaccccctctgtattttgattctctgataaagattaacttcagaattggcttccaataagatataaaagacacttccaattttctttgaaatttatgggtgagagggttcctagttgctattttcctgagccagatgctgaaatgaagacttgagtgcagatcattgatgtaggaggtgatcccaggacacacaagtgagaaaggaaggagaaaacccaggaaagggtaggctattgagcaaaaaaaccttatccactatgagtgacagggctcaattccctggagattttcccctcaatttggagtgtgtactatatagctcagaaattcctcactgaggggcaaagaagctggagtatttacttgtccaccaaatcccatccctattttgttgagggctttctaagaacattaaacctatgacattccaggatgccctggtttgggcttgagcaggttcccttggggacagaataagcctcagccccaccccccgaccccggcgagcatcacagtagccagtatgtaggaaaactgtccattatagcttcaggttaacttgcagattggccatgagaatagggagcagggaatccagcaaggagtagtggacatctattgtctttgcctgccagtttccattcccctaactttttataatagtacctcaattcccttttagttagagagctacacacttaattctttccctccgcatggtgaaggtgggttctcattaggatggagctgaccccactatcctccaggctctggattggacatgagacacaggaattgtcagtcagcatatttcttgctttggatctaatagttggcttaggaatagtcatatgagataaactggtccctgcatttcaactcaatgactcttaactattggagaagataaattctcacctcccctccaaggctgctgaattaggagggcatacacctgaagaggctggtgaccacctcatggaaagcacctacaagagaggaaagcagggctgtaaaacagagagacacacgcagatacagacaggcagacagaggatccagttatgctcaacccagctctacccttggacttttcaattacatgagtcgataaactcttttttttttcttaaatcagtttgaggagagtttctcttaccagtattatttcttcaccaaaatgttttcagtgtctacatagtctcttaacttctgagtatttttcatttacttagaagcttaggattcttaattgaaatagacatttaaagtctgctagaccgatcttctcacaacgcaggaacatcatctacagctgtgctgtccaatgtgacagccaccagcctcatgttgctatagagagaaggcatgtggcaggtccaaatgagagtgctttaagtatagaatgcacactagatttggaaaacttggtacaaaaaagaagataaaatatcatacataattattctatattgattatatatcttaaaagtcttttggatatattgggttaaatagaatatattattaaaattaattttacctgtttctttaaatttattaatgtggctactagacaattcaaaatcatatatgcaactcacattatatttctattagacagtgctagtccctgacaaagggtgatgcagcctctgcttgaaaatgcagctaattaaccctctgggcaggcgcatccatcattggactgttctaagtgtaaaaacgattttgtgcctctacattcaaaatccatcactttggaacttccatctattggcactagttctgcctcttgtgtatcacagagtatctactcttcatacatattcagctatttttacttcttactggaagattgccatccaacctgtctctcacagtcttatgaaacaggacatcacagacatttttgactcccgctctgctgacaggatacgctatttgcattgacaacagttgcaggtttggtagccataatctttctgtgcttaatgataaattaggcttcatcttcttgtgaagctacagacaaagtagagacttctgcttgaggctccagaagttctctctgccccaaaagtctaaatgagagaggtacaggagttaaggacatccatcagggatgtcattccttgctctgagttctatcacgggaaatgaatgtggactttgggatgagaaaagggcagttgtcaacaggaaatagcagctctgagttcattttcagcagacaacagtctgttccaacataacctactccaacctaagcttcatggagacagactggggctgacaaaaggtaaatggttttcatgtcactagtgtctttaaagaaataccaataaatttaatttccttcttaaatttaacaatccaaacaagtaaggtggaatgcagcagactgttatttaagtatgtcatgaagatttcaagttttagatcttgatgcctattttcatgattaaacaaaattaaaatctttcaagaaaaaaagttatggttccaaagactgttgtctgtgattatgatatattcaaagtattttcattgcaatgttgtggacatccatgataaattatgccttcttaattgggattatttttatttcaggcaattggcactcttgaaaataaaaacccatctgtccaaaaccattttttcatttcctgtcatttcagcttagattgcaccactaatctctgaaatccacattctagtctagtgatcaaacaaaagttttttctgatctatggaaaactttttattgcaaagaaagttcttaatgaaaaagttaaataagacaagttcaaaagtttatacaaggcactagttagagcatctaggatttgtggataaaataatatgccccaattatccggatgtgtaatttaggaagtaataaattgtatgctgatgaatctaattcaaaatatcaatacatgctaaggtactctacagcctgttcaaacaccctccccaattgtcttgtttcaattactatcaacagccacaaattggagttctgtctatatgatgccccaaacatttggttaattcagttcattcaacctagttaattcaatatgcaaaaaaattcaccaatgaattgacaagctaatgttctcaaaattgttgatcagtgagttgtaacctaagaagatttggctaagacagtctgaaaagccagggctctcctcccatctcactattccttcaacaactcattttgcttattccttccacttacaataaacttcagcatcttatagtgcctcttttaccctaattcaataagccttctctatcattaaacccaaagtttctaaagtcttatctctagaccattcctggacaattaaaagagtataggtgattcttctaagcagtttggagattcaacagtcctctctgaaaagcttcctaatttatgacttttttatcttctatcctagaatatgtagacactgtgggccccaattaactttctctattggtggatggaacctaagataactcaataatctccccttatagtactcatgcccttgcataatcctctcctcttgagtgtgagtagcatctgggatttgcttctaactaatagaatatgacaaagatgacatgtccatcccacgatttattatattatatggcaaaagtgctaggatgttattcccatgattattttacattacacaagactaggaggagcctgcacatctagcagaagagaaactaaggggcccaagctctccaaacatccctggctcattgggtgactgcatgcctaggcaagaaagatctggagagcacagaagatccagggataatctacaaattgcctgagtttttagtgtactccataacccccacacaggtgcaatagcagaggataggagatttactggctttaggtgtgtcttagtcagttcaggctgctataatagaatactacagactgagtagtttaaacaacaaacctgtgtttctcacagttctagatgctaggaaatctaagatcaaggtaccagcagatccagtgtctcatgggggcctacttcctaaattgcagatgattggcttcttattctatcatcacatggtagagacagacagaaaccaatccctcatgtctcttcttatgagggtactaataacatttataagggatccactgataccatcacattggcggttaggattttaacatataaatttggggggaacacaaacatgcagtccatagcaaggtgtttgagcaaacctctaaccagtcattgactgaccactaagttatgcagacttataggtgacctctaacagcccaggataaaaaataaaataaaaataaaagcagaattaaaaaaaaaaaactaagcagagacttcagcgaccagaagccaagattaaacctagaaaattattttaacacaaaacaaagcaaacgagtaacaactgacaggaggctggtgggcggggggtggagggaatgcagaatccagagttgagatatattatctaaaatattcagttttcaacgacaacaaaaaatgagacatgcaaagaaacaagaaagtgtgactcaaactccaaggggagaaaaaattaataaatagatatttgtctctaattggtattgtacattttatcagacaaagacttcaaagtattaattatcaaaatgtccaaaattttaaaaatcatgtttaaataataaaagtggtctggcacagtggctcgcacctgtaatcccagcactttgggaggccaaggtgggaggatcgcttgagcccgggagttcaagaccaaacagggcaagatagcaagatcccatctccacaaaaaataaatgaataaatacataattaaaggaaaatatcccaacaatgactcaacaatagaaaatctcaataaagaaagagatttttaaatggatattttataattgaaaattacaataaattgaaatgaaaagttcactaagcagtttcaataatagatttgaaatggcagaagcattaaacttgagaaacagaaattattcaatttgatgaaaaaataataataattaaagaacaaataaaagaacctcagagatctggggaaaatatggaacataacaatataaatgtacttggggtgtcagaaagagagatgagagagtaagtagcaaaaataatgtttttgaagaatgaatggcccatagcttatcacatgtataaaaaaaaagatctatagattcaagaaacttgacaaacctcaggtaggataaacacaaggagagtcacacttcaattcactatagttaaaatgctgaaaatcaaggagaaattcttttttattttttatttttatgggaacatagtagatatacatatttattgggtatgggagatactttgatacaggcatacaatgcataataatcacatcagaataattgggatatccatcacctcatatatttatcctttctttgtgttacaaacaatccagctttatcattttggttattttaaaatgtagagtaaattattgtttactttaggcactgtgttgtgctatcaaatactagattttatttatcctatctaactatatttttgtactccttaaccatccctactaccccccactattcttcccaccctctggttacaattattctactttctctctctccataaattcaattgttttaaattttactacctgcaaataagtgagaatgtgcaaagtttgtcttcctgtgcctggcttgtttcacttaacatgatgatttcaggttccatctatgttgttgcaaatgacaggatctcactttttatagctgaatagtacaccattgtgtatgtataccacattttctttatccattcatctgttgatagacactttgttgctcccacatcttggctgttgtgattagagctacagtaaacatgggagtgtagatatcttttgacagttttttgagaaacgtccaaagtcttctccacagtagttgtactgatttacattctcaccaaaaagtgtataaggattcccttttcttcacattcttgccagcatttattgcctttcttttggataaaactattttaactggggagaaatatcccattgtagttttgatttgcatttctctgacgttcagtgatgttgagcatctctttatatgtctgtttgctattcgtaagtcttcctttgagaaatgtctgttcatatcttttgcctacttttttttttttttttgagatggagtcttactccatcatcaggctggagtgcagtggcacgatctcagctcactgcaacctccacctgccaggttcaagcgattcttttgcctcagtctcccaagtagctgggactacaaacgcacgctgccacgtccaactaatttttgtatttttagtagagacagggtctcaccatattggccaggttggtctcgaactcctgatctcatgatctacccacctcaccctcccaaagtgctgggattacaggtgtgagcaaccacgcccggctcttttgccctttttttattggattattagatttttttcatatatatttgtctgagctgcttgtttattctggttattaatctcctgtcagacatacagtttgccaatattttctccctttctgaggattgtctctttgtttattgtttcctttactgtgcagagctttgcccagtctaatgtcttggagagtttccccaatgttttcttttggtagcttgatgatttgagatcttatacttgagttttttaattcactttgatctgatgtttgtatatggagagagattggagtatggtttcatttatctgtgtatgcgtttctggttttcccagcaccatttattgaagaatctgtcctttccccaatttatgttcttggcacttttgccaaaaatgagttcactgtagatgtatagatttaatcctgggttctctattccgttccattgatctatgtatctgtttttatgccagtaccatgttgttttggttactgtagctctgcagcataatttgaaatcaggtagtgttatttttcctcaggatagctgataaggtttggctatgtccctgcccaaatctcatctcgaattgtaatgccataattcccaagtgcagtgggagggacctggtgggacataattgcatcatgggggcagatctttcctgtgctgttctcatgatagtgaataagtctcacgagatctagtagttttataaaggggagttctcctgcacacgctctcttgcctgccaccatataagacatgcctttgctcctcactcaccttccaccatgattgtgaggcctccccagctatgtggaactgtgagtcaattaaacttcttgcctttataaattacctagtctaggatatgcctttattagcagtgtgagaatgaactaacacaatagcattgtctattctgggtcttttgtggttcaatataaattttgcaattgtttcttctattgctctgaagaatgtcattggtattttgacagatattgtattgaatctgtagactgtttttggtaatatggacattttgacaatattgattcttccagcatatgaacataaaatatctttccatttttctgtgtcttaaattttatgcatcagtgtttcatagttttcattgtagacctctttgatttctttggttaagttaatttctgcatattttgctttatttgtaggtattgtaaatgagattactttcttggtttctttttcagattgtttgctgttggcatatagaattgctactgatttttgtatgttgattttgtatcctgcaactttactgaatttgtttatcagttctaaaagttttcttgtggagtctttaggtgttaccaaatataagattatattatctgcagacaaggatcacttaacttattcctttccaatttggatgccctttatttctttctcttgtctgattgctctagctgggacttgcattactatgttgaattacagtggtgaaagtgagcatccttgtcatgttccagattttagaggaaaagctttcaatttttgcccatttagtgtgagactagctgtatgtgtgtcaaatatgacttttcttgtgttgtgatatgttccttctttactcagtttttttagggtttgtatcacaaaggatgttgaattttatagaatgctttctcagcataaattgaactgatcacatggtttttgtactttattctgttgacatggtgtattacattgtttgatttgcatatgatgaattatccttgcatccctggataaatccaacttggttatgatgagagatctttaaatttattgttcaattcagtttgctagtattttgttgaggatttttgtatcaattctcatcagggatattggtttatagttttcttttattgatatgtttttgcctggttttagtatcagggtaaaactggcctcatggaatgaatttggaagtatttcctcctcctgtattgttcagaatagtttggatgtgattggtatttgttcttctttaaatggttggtaaaattcagcagtgaagctatcacgtcccaagcttttctttgctgggaggcttcttattatggcattaatctaggtacttgttattgggctgttgtgaatttgggtttcttcatggttcaatcttgggaggttgtatgtgtccaggaatttatctaattcttctaaactttccaatttattgtcatataattgttcacagtggcctctaataatcctttgaatttctgtagtatcagttataatgtccccttcttcatctctaattttatttatttgggtcttcgttcatttttttcttcatttaccttgctaaaaatgtgttgattttgtttatcttttcaaaaaacaaaattttcattttgttgatagtctatattgttttattcatttcaatttcatttatttctactcagctatttattatttcttttcttctactagtttttcacttgcaatgctcttgctttcctagtttttcaagatgtcattatattatttatttgaagtttttctacatgtttcatgtaggcacttacattataaactgtcctcttagtactgctattgctgtattccataggtttttgcaggtcatgttcctacaataatttgattcaagaatttaaattttttttaattttctttattgacccactggtcattcaggagcctgtcattaaatttccatgtgcttctatagtttcccaaattcctcttgttattgatttctagttttttctagtatccattgtatattctgcagccattggatgaagtgttctgcaaatatctattaggcccatttgatctattgtacagtttaagtctgatgtttctttgttgattttctatctggataatctgtccaatgctgaaagtggggtgtttaattatccagctattattgttttggatctacctctctctagctcaaataatatttatttatctgggtacacatatatttacaacttttatatccacctgctgaattgacctctttatcattatataatgatcttcttcatctctttttgtagtttttgtcttgaaacttatttgcctgatataaatatgcctactcctgctttttgtttccatttgcatgaaatacttttctcatcactttgctttcagtctatgtgtgcctttataggtgaagtgtgtttcttctaggggtcttatttgttgggtcttcttttcctttcttttttctatatcaattcagccaccatatgtcttttgtttggataatttagtctatttacactcaatgttattatggataagtaaggactttcttctgcaatattttaatttattttctgagggtttttttgtgaccttctctttcttcttccttcctatcttctgtttagtgaaggtgattttcttcagtggtatgtcttaatttctggcttagtttgtgtgcatttctattgtatgttttctgatttgaagttacaatgaggcttgcaaataatatcttatagcccattattttaaactgatggccacttaatactgattgcattaaagaaaaccaaataaactaacaaggaaagagaaaaccaataacagctgtatactttaagttcttgcccctgcttttaaagtttttatagtttctatttataccttattgtataccctatgtcttgaaaagttgttgtacttattatttttgatcagttcatcttttaatctttctactcaagttgtgagtagtttatacaccatgattatggtattataatgttctgtgtttttctgtgtacttattattaccagtgagatttgtaccttcagatgattacttctcactcattaatgacattttctttcaaattaaacaactccctgtagcatttcttgtcaaaaaagtctggtgttaatgaagtttttcagcttttgtctgagaaagtctttatttctccttcatgtttaaagaatattttcactggatatactcttctatggtgaaagctttttccttcaacactttaaatatgtcatgccgctctcatgctctccagggttgccactgacaagtctgctgccaggcacactggagcttcatttcatgttatttgttttcttttgctgcttttagaaactttctttatcctcgacttttgggagtttgattattgaatagtttgaggagccttctttaggttaaatcaacttgttgttctataattttcctgtacttgaatattgatatctttctctaggtttggacgttctttgatattatccctttgaataaactttttaaccctatctctctgtctacctccactttacaggtaataagtctcagatttgctcctttgaggatttttttttatcttgtagatgtgcttcattcttttttatttttttctctttggtatcctatgactatgtgttttcaaatggcctgtctagctcactaattctttcttctgctttatcaattctgcaagtaagagagtctgatgcattcatccatatgccagacattttcaacttcataactactgcttgattattcttaagtatttcagtctctttgttaaatttatctgacatgattcttaattttttgtttgttataatgatttaattgaaattccaccaaaaagctactttgaattctctatctgaaaggttacatacgtctgtctctccatgattggttcctggtgccttatttagtctgtttggtaaggtcataatttccttgatagccttgatacttgtggacgttcatcagtgtctgggcatagaaaaattaggaagttattgtagtcttcatagtttgggcttgtttgtacacctccttcttggaaacactttccaggtattcaaaggtccttgattgttgagatctaagtttttggcttctgcagctgtgtcagcattaggagacattccaagccccatattgtagcacttgaagacttgtagaggtagcatgttggggggcttggataagacccagaaaaattctctagattatcaggcagaaactcttattctcttcccttactttcccccagacagagtctctgtatatgctgagctgcctggagctgggggaggagtaacacaagcatccctgtggccattaccacggagactgtgctggatcaaacctgaagccaatacagcactgagtctctcccacagcccatggtaaccacatcctggctactgcctaagttctcttaaggcactagacccttaaaatcagcaagtgggaaaaccagccaggtttatgtccttccctttaaggcagtgagttcctgcagtccaaggtaggtttagagatgctgtctgagaaccaggtcttggaatcagaaacttaaggaatctaccagatactgtatgctacggcagctgagctggcactgaagccacagaacaaagttcttaccattcttctctcccctttccgcaagcagaggagtgtggaactcttcccacagtcaccactaccacaggttcacaacaaatattgtctggctactgccaatgttcactcaaaacacaagcactcctaagtcaccttgtagtgaatactgccaggcctgggactctcccttcagggaagtgggctctcctctggcccagaacaggaccagaaatgctttgagagggcgagagactggaatcaaagaccccaagtacccactttttgctttattccactgtggccgagctggtatctaagctaccagaaaaagtcccctttactcttccctctcttttctcaagcagaaagagtccctcctcatagctaccatagctgggaatgtgctgggtcacacctgaagccagaatatctttgagtctcacctaggctcacagtgggtactgcctgggtattcctgctgattattccaggcccaaaggctcttcagttagcaggccatgaatcttgccaggacttgatccttcccttcaaggccacaggtttctttttggcccagtgtgtccagagatgtcatgtgggagctagggcctggaatgggggcctcaggactctgccaggtgccctatcctactgtggctgagctggtatccatgttgcaagagaacctcctctttactcttccctctcctctcaagcagagggaaggaatctcttacaaagctgtgatctgtactagctggtgttggtggggaggggtgacacaagctctttcttgactgatgtagctggcatctcactaggtcacatgctccccaagttcactggcaccaaagtccacacagcactaaagcttgcccaggagcgcagtccttatgcttagcctgcttcttgcatttacttaggaccctagagcactcacccttcaatggcaaggcttgccagaacctaagttctgaccactggcatggatgattctcctctgactagggctgttataaatgctccctacatggtgtcagctgagttttttccagtgttgctttccactgagacagcacagaactgtgttccaacacaaagtctcacaatcactgtgctctccctgtcccaatcccacatattctctctctgtggcaagaaagccaaaaaaaattgaatttacactgcatgttagaccaaatagacctaacagacatttacagaatattttgtgcaacattgtcagaatatacatctttctcatcagcatacagaacattctccaagatggacaatatgttagaacacaaaacaagtatcaacaaatttataaagttcaaaattataccaagtatcttctcataccacaatggaacaaaactagaaatcaaaacagtggtaaaagggaaatttatagtaataaacaactacatcaaaagaaaatcttagaaaaaattcaaacgaccaaataatgcacctcaagaacctaggaaaaaaagaacaaacaaaaccccaaattgacagagaaaagaaataataaagatcaaagcagaactaaatgcaatggagactacagaaacaatacaaaagatcattgaaacaaaaagttggttcctagaaaagataaacaaaattgataaactgctaccctacaaaacaagagggaagacccaaataaacaaaatcagaattgaggagatattacaactgacaccagagaaatataaatgatcatcagagactattatgaaccattataagctaacaaactggaaaaccctgaggaaatggatatattcctaaaaatatacaacctactgagattgacccaagaagaagtagaaaacctgaacagttaaatagtgagtaatgagattaaatcagcaataaaatgtctcccaacaaagaaaagtccaggaacagacagatttatcaatgaattacaccaaatgtataaagaactaataccaattccctcaaactatcctaaaaattaaagaggagggaattctccctaactcattctacaatgatagcatcatcctaataccaaacccagacaaggacacagcaaagaaagaaaactacaggcctatatcactgatgaacatagatgccaaagttctcagcaaaatactagcaaaccgaatccaacagcatatcaaaaaaataatataccatgatcaagtgggatttattccagggatgaagaaatggttcaaaatatgaaaatcagtaattgtgatatatcacatagacagaattaaagacaaaagtcatatgataattttattagatgcagaaaaagcatttgataaaattcaataccctttcatgaataaaaactctcaactaaaagttaggcatagaagaaacatatctcaaaataatagtggtcatatacgacaaacccatagctaatatactgaatggaaaaaagtcaaaagctcatcttctaagaactgtaacaagacaaagatgcccattttcaccactcttattcaacatagtatagaacctccttagcatagcaataagacaagagaaagaaagaaaaggcctccaaattggaaaagaagtcaaattgtccctctttgcaaataacctcattttatatttagaaaaaccaagatttcaccaaaaactcttagaacttacaaacaaattcagtgaagttgcaggatacaaaattaacataaaaatcagtagcatttatatatgcaaatattgaaatagccaaaaagaaatcaagaaggcaattccatttaaaatagctgcaaaaaataaataaaatatatatgaataaatttaatcaaggatgtgaaatatatctacaagaaaaactataaaacactgatgaaagaaatgaggagggcacaaaaaaatggaaggacattttatgcttgtgggttggaagaatttatatcattaatcataccacccaaaggactctacagattcgatgcaatctttatcaaattgacaatttcatttttcacaagaatagaaaaaaaaaatcttaaaatgtgtatggaataaaaaatgagccagaatattcaaagcaatcctgaactaaaagaacaaagctggtggcatcacattatctgacttcagaacatattatgaagctatactaaccaaagcagcatagtattagaataaaaatagatgcatggaccaatggaacagaatagagaacccagaaataaatccaaatatttgcagccaactgatatttcataaagcctccaagaacatacactgggtaaaataaaccgtcttcaaaaaaaaagaaactagatagccatatgcagaagaatgaaactggatccctatctctcaccatatacaaaagtcaactcaagatggattaaagattttaaggtaagatggattaaagattttaaagtaagacccaaaactataaaaccattagaagaacacatagaaaaaactctttgaaacattgctctaggcaaaaattttatggctatgacctcagaagcacaggcaatgaaatccaaaataaacaaatgggatatttaactaaaaatctgcacagcaaaataagcaattaattgagtgaaaagacaacctcttgaatggagaaaacacttgcaaactacttattcaacagggtattaatatccagaatatacaagaactcaacaggaaaaaattctcattaaaaaatggaaaaaagacatgaatagacatttcttaaaagaagatatgcaaatggccaacagtgtatgaaaagatactcgacatcactaatcatcagagaaatgcaaaaaaaaactacaatgatatatcatctcactccagttagaatgccaattactaaaaagacaaaaataacaggtgctggcaagcatgctgagaaaagggaatgcttatatgctgttggagggaatgtaaataagtaaaaccactatggaaagcagtatgtagatttcttaaaaaaactaaaaatttaattaccatacaatccagcaatctcactactgggtatttatccaaaggaaaagaaatcagtacatcaaagggacacctgcactcacatgtctatctcagcactattcacaatagcaaagatttggaattaacctaggtgtccatcaatggatgaatggataaagaaaatgtggcacatatacataatgggaatactatctggtcataaaatagaataaagtcatgtcattcactacaacgtggatggaattggaggtcattaatttaagtgaaataagcaaggcatggaaaggcaaatactacatgttcttactcatatgtgagagctaaaaataaataaataaataacttggtcacatggacacagagaatagaatgatacatacgagataatggatagagtgggtgaatagaagaagggaaaaatgaaaagaagttggctaatgggtacaaaatgcagttagatagaagaaaaagttctaatgtttgttagcagactaaggtgactgtacatagtaacaatattgtgtgtatttcaaaataattagaaaagaggacttgaaatgatatcaaaacatagaaatgatactcaaggtgatagataccccaaatgctgacttgatcattaaacattctatgcatgtcatgaaatgtgcatttttgtaccccacaaaaacattatgtattaataaaagataaaataaaataaaactttttaagtttacagacatgcacaaaaataattgataacagagtgctaaggactgaaagcttttgtccccccaaaattcatacattaacatcctaatcccaaagatgatagtataaacagtggggtttttagtaagggattaagtcatgagggctttgaatggaattaatgcccttataaaagagcccccagaagccagatagccctttctaccatgtgaagtcactgcaagaaatcagcagtctgcagcctggaagaagatcctcagcagaatccaaccatgctggcactctgattttagactttccagactccagagctgtgagaaataaatctctgttgcctataagtcacccagtctatggtatttggttatagcaggtggagcagaatgagacacagagaattagcaaggatataaaagacctccacaacactagcaaccaagttgacctgactgatactctgtaaaacgttccacttaacagcagaaacagcagaatacacttttttttttttttttttttgagacagggtcttgctgtggcacccaggctgctggaatgcaatggcaagatctctgctcactgcagcctcaacctcctgggctcaagcaatcctctggcctcagcctctagagtaggtgagactacaagggagactccagccatgtgccaccacatgcagctaaattttttatttttttgtggagacctgtattttgttttttgtttgtttgtttcaccatgttgcccaggctgttctcaaactcctgagctcaagtgatccacattcttcagcctcccaaagtgctgggattgcaggcatgtgccaccgtgtctggcccagaatacacattttttaaagagcacatgcagcattttccaggacagaccaaatgacaggctgtaaaacaagtctcaataaattttaaaggattaaattatttaagtgtgttctctgaccataagaacattgaatagaacggaaactaaaacataacgtatcaaaatgtacaagacacagctaacacagttatgagaggtaaattgacagttataaatggacatattagaaatgaaaaaggttttcaaacaatttgtctagatgttcacttcaagtaactagaagaagtgcaaactatccctaaagcaagcagaagtaaagaaataataaagagtaaagcaaaaactaataaaataaaaatagaaaaacaacaggaaaaaatcagtacaaccaaaggttgctactttcaaaagaccaacaaaactgataaagctttagctagactgactaagagaaaaatgaaagaaggcataaatcatgaaaatcagaaatgaaagaagggacataattattgaccatacagaaattttaaaagattataagataatactatgagcaactgtatgccaataatttagacaaactaccaaaaaatggacaaattaccaaaactgactcaagcagaagtataaattttgaatgtactgaaaaagagaaaataaataaattagtaactaaaaatcacccaacaacaacaacaaaaatatcctaagccctgatagcttcactggtgaattctatcgaatatttttataccaattcttcacaaattccttcagaaaatagagcatgaaggagcacttcccagcttctgttgggctggtattacttagacaccaaggccacaaaaagacgtcacaaaaataaaaaacatagatatatgaatcttttttcagacattgacaatccaaaatccagcaacatatgaaaagttttattttcaaatgaaaactacagtgaaatagtcacttcacacccactaattgggctatgatttaaaaagacagacagttacaaatgtgggtgaagatgtagagaaattaaaaccttcatccactgctggttcgaaatgtaggatgatgcagctgctttggaaaacagtctgacagtttctcaacaaattaaatacagaacttctgtgtaaaccagcaatttcccttctaagtatatacccaagaaaaatgaagacataaatccacacaaaaatttgtacacaaatgttcacagcaactttactcataacagccaaaccataattataactcattaattttcatacaatgaaatgttattcagcaataaaagtaaatgaatcactagtatacactgcaatgtagataaccctcaaaacattataagttaaagaaaccattcacagaagaccacatggtatatgataccatttatatgtaatgctgtaataggcaaatctatagagacagaaagtagatcagtcgtcacttacactggggatggggtggtgaggaggaggagagatggagagtgactgttaatgggcattgggtttctttttgcaattatgtgaatgttctaaaattagattgtggtgatagttgcacagctccgtggatatactaaaaatcactgaattgtgcactttaaatgggtgaattgtatgctatgtgaatatatcataataaaactggttttaaaaagttttatatactatgacctaggggaattcattccaggaatgcaagattagcgaacatccagaaatacagtctttctctgactttttatgttaaaaataatactgcaatgaatagacatattgtcatcttttcagagggttgttaaaagacaatacatcactcctctattttctttttcagtttaaaattaagctggaaaatgacacaggaaatggataaatggaaatcagaatatgatccttatttctcataaatccagttgaagagcatggctttagataggcaattaaagtgtctttcgaatccctgcctctcaaactgagcaccctcacaactggacagccaggtgttctccatggggccggtacggaaataagtgtcagagagcaaatcatgctttcaggcaagttggttctcccatccctacttccataccaccaccaccacacccccctccctgcaacaaaaagaaaaaagtgctcaattcaagtgctcccaacctcagcaaaggagttttagtccctacaaatgtacatataaaaaatggagatagatgatactcccataacaagtagtcttgcagagctacttacactagacatgtggaatcataattaaaccttcttatgaataaatatttgtggaataaataaatgactaaataacacatttaacagtatagtactgaattgtttttatcccatctggggtaatatttttattaagtgtctttcatttttatatattgcagggagggacagcttgaggataatcagtactttccagtaaaaccctgccccactcctgtactcctaagggattgccacctgctttcagagtggccaaattctgcttcacttctcatctcctcatataaaggattcatgttgaattacctagcaaagttgaaaaaaaacacctacagagggtccatcatgggtgatctagggaacagtaacagaagggcacaaaaaagaaaattggtcttgtaattgcattctgtcaaacagctagataagcagccagcagttttgcattagaatgcattcggttatcctatttacaatgggctagtaatcccataaatatttattgctgaactaaaaaaagcaacataagcttttaccctttgagaaaggtctgtaacatgcatggtgtcagtaaagtaggaaaccctgatgatttggttacttcttaatatgttagagtctggactgtgcttggcacatgtgaacagtttgaatgcagttgtcagtgcttgttcctggaggacaattgtaagcatatgtttcagtaggtgagctatcaaacccacagctgctctctaccctgaacctgaggcaggacaatgggaaacccaggcattggcagatttaactttgaatggttgagtacagggatcaatccgtttagagagcaacaaatgcaagaacagcaggagaaaaacagaaaaagaaaatacttttcttgagatgattctgtatctgtgtacattacataattttaatcattcattgtggcttgagggaaataactgatgctttccttgaaaggcatggcattcctcaagcaataaatatatttcatttccagttttatatgctgtatgtgtcaagtaaacaaatattaaaaacatatcgcttattgttttacaggtattttcatattctgtttactctccaaaagatttaggcagctagcaatagaagcacaaaaattgaaaagaccaaaaacagctattaataaaacaaagaaaatagtcaaaaataagagaaaggcagagaaaaagaacaaaacctcctgcccccaaaatctccaatagttagccatgatacttaattataaacttcctgtgtaaccaggacaaagaggaaaactcagttaataaatactatcatcctctttttttaaaattattattaatatactttaacttttagggtacatatgcacaacgtgcagatttgttacatatgtatacatgtgccatgttggtgtgctgcacccattaactcatcatttaacattaggtatatctcctaatgctatccctccccacttcccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggatgggaactcatcattttttatggctgcctagtattccatggtgtatatgtgccacattttcttaatccagtctatcattgttggacatctggcttggttccaagtctttgctattgtgaatagtgccgcaataaacatacatgtgcatgtgtctttatagcagcatgatttataatcctttgggtatttgggtatacacccagtaatggggtggctgggtcaaatggtatttctagttctagatccctgaggaatcgccacaccgacttccacaaaggttgaactagtttacagtctcaccaacagtgtaaaagtgttcctatttctccacatcgtctccagcacctgttgtttcctgactttttaatgatcgccattctaactggtgtgagatggtatctcattatggttttgatttgcattcctctgatgggcagtgatgatgagcattttttcatgtgttttttggctgcataaatgtcttcttttgagaagtgtctgttcatatccttcgcccactttttgatggggttgtttttttcttgtaaatttgttggagttcattgtagattctggatattagccctttgtcagatgagtagattgcaaaaattttctcccattctgtaggttgcctgttcactctgatggtggtttcttttgctgtgcagaggccgtttagtttaattagattccgtttgtcaattttggcttttgttgccattgcttttggtgttttagacatgaagtccttgcccatgcctatgtcctgaatggtattgactaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcttttccccattgcttgtttttgtcaggttggtcaaagatcagatagttgtagatatgcggcattatttctgagggctctgttctgttccattggtctatatctgttttggaaccagtaccgttctgttttggttactgtagtcttctagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctctaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattgctaggtattttattctctttgaagcaattgtgaatgggagttccctcatgatttggctctctgtttgtctgttactggtgtataagaatgctcgtgatttttgcacatttattttgtatcctgaaactttgctgaagttgcttatcagcttaaggagattttgggctgagacaatggggttttctagatatacaatcacgtcatctgaaaacagggacaatttgacttcctcttttcctaattgaatgccctgtatttccttctcctgcctgattgccctggccagaagttccaacactatgttgaataggagtggtgagagaagaatcaaatagatgcaataaaaaatgacaaaggggatatcaccaccaatcccacagaaatacaagctaccatcagagaatactacaaacacctctacacaaataaactagaaaatttagaagaaatgaataaattcctggacacatacactctcccaagactaaaccaggaagaagttgaatctctgaataaaccaataacaggctctgaaattgaggcaacaattaatagcataccaatcaaaaaaagtccaaggccagatggattcacagccgaattctaccagaggtataaggaggaactggtaccatttcttctgaaactattccaatcaatagaaaaagagggaatcctccctaactcattttatgaggccagcatcatcctgataccaaagcctggcagagacacaataaaaaaagagaattttagaccaatatccttgatgaacattgatgcaaaaatcctcaataaaatactggcaagccaaatccagcaacgcagcaaaaagcttatccaccatgatcaagtgggcttcatccctgggatgcaaggctggttcaacatatgaaaatcaataaatttaatccagcatataaacagaaccaaagacaaaaaccacatgattatctcagtagatgcagaaaaggcctttgacaaaattcaacaaccttcatgctaaaaactctcaataaattaggtgttgatgggatgtatctcaaaataataagagctatctatgacaaacccacagccaatatcatactgaatgggcaaaaactggaagcattccctttgaaaactggcacaagacagggatgccctctcttatcatcctcttattttaaaaagttatgagaatttctcaaaactgcacatcaatacaaaatgtgtttttcttgctgtcttggtgtgatgctgaataccactaggcagtgagcaagaggctcttttccttgtgtgtgtgtgtgtgtgtctgtctgtctgtctgtgtgtgtgtgtgtgtgtgtctgtctgtgtgtacagcagaaattctaaaaggaaaataattattctctcttaaatatctgctgtatgtctagtacgtttccaggcactggggatacacagaaaacaaaacagatgtggtcttgccctcactgcacttaaaagctattgagaaagacatgctttgggcaagtaataacaactctgataagtgctactcacagtgatgggtgcataatcctcccatcacagataacagggagattcggcttagccctggtcagtagagcatttatctctgcctaggtgagtggtaggtttaaatatgctaaagtttaaatcctatctcggccgatgaccatccccatagcctcagccatgttgctcaccttctccgtagtaattgtattattgtgaggactaaataggtcttttctcatggcagtctcatgactaagagtatatcagcagaagcttcaaggtctctgagtccaagtcttaaaactcctcaaatctcacttctgctgcatcccactggtcaaagtaagtcacaaaggcaacctagattcaaaggatgagaatacagtttccacccgtttagaggaaatgcaaagtgccatggccattttggcaatcttccacatgacagtggagaatataaaatgaaccaacaagaacataaaatgaacagctcttagtgtatgactggacatggggaagtggaagaaaaaggaaaaaaggagccaatgatgacaccacattttctgtccagagcaaactatgtgggtatttttgcaaatcacttggtactgaattgagaaccagtgaaaatttaaccaacaattttagaatattttgttattatttggagtttttcaaaggtccaaataaatgactcaggctggtgtgagaatcataatcctcaatattattaaatattgttgaatttgttttgactttgatcctcaaaactgaaaacattcttcaatgtgtagaccaagacataaattgcttatactagttccattacaacaaattccacatatatcctgattgataccagttatgttgaagtgtttctaacactgtaaatgcctattcctcccatgtgagaattagcttattttaaggtgttttgactttcacttatataatgattgaaaacttccctgtgaaaaaactattatccatcttcataacagtttccagaaaaattaacagcactaccttaccaaaggacccagaagtaaacattattgaatatattttttgtttgtttttgtttctgtgctgattgttctgtctttcttggctttattgaggtacagttgacaaaaattgtatatattcaaggtgtacaacctgatgttttgatatgtatgcattgtgagataattacactatcaagttaattaaaatatttatcacctcacatagttccaggtatcactacctctttagttaaattcatgaccagggatactaatataaaaatttcaatagtctgagacctcttatcctcaaccctacccatgtaaatgaaactctggtggcttcaatgtgaatactcctaaatatctcttcctgtcttcctttctgcatctatgcagccactgccttaatttaagcttggaacagtacctgaataggtctcccttcctgtacctcccccttttaaagctattgtctgtatgtttctaaaatgtaaatccaattattaacttatcaacttaaaaaaagtgaatttctctatcagagagtccattccaaaccaatattttcaatggattacagaataaattagcagatttatttaacctattctcaaactttcaacaagagaaagcatacatttgcaaggaaattggactgttatttccaagccacactcttcattttcttggctataattcaagcagcatgttcaacattatttgggtggagacattgaaatggagagaagaataaaacatggtccttgttctcaaggaccccatagccctgtaggtaagacagaccttcaacaggtaatagtagctcagtgtgatacacactaacataaagttagaggaccaaggtatcaaggaaaagtggattgaggaagggatctggtgaaatgtgggaacatttcacagataagctgacacatgaataagtcttgaaagatgaatagaaatttataggttaaaaagccagggaataatattccagtgaagggggaacagcacagacaattttatgaagatgtaaaacaacatagtacattcaggtgagtgaaatgatttagtgtaatgatttaataggaaaagtggtggaagataaggaacaaaaaggtaggtgggtactaaacccatgaagggcttcctactctgtgcatgcccaaggtgatatacatagggtgcagtgttgggttgaaccataagagataatcctttatgttggtcaaaagagtcaactattggagtttcagagatgcaaaatactacaattcatctgtggagtcttaagccaccttcaactttggcatttagaagtgagtatgcctaacctgacacatccgcttgtgagaaaaagaagcccagtcaacgtttttcaggtagtgggtggttttaccaagggaaaaaaaaaagcactcccaaaagtccaagaacaagagttggactcagctgatggaaatgatccccaccctgccttccccatagcttgctggtttttttgtaaatttcatttttctttctccgtcaattgacattttttacttatagtttctgcttcctcatggctttatctcactatagacatggcaccccaagcccttctccaaatcaaaactttttggcttcagctttctcagcaactgagaacttacaaacctgttttgaaatcctgaaaggatgaatctcattggttcagctaatcttttttttactaggctgtgggttactggccagtttatgagctggttgtccctctttaagtccactacctatcagtagatccattacctgtgactgtgggaataacatggagacgtagtggtaggagggtggatgggaccacttccctcagaagtgattatggtgggcaggcctgttgaggctgagcagctctgcttatttctcccagtaaagttggcataaaagcctctgagttgattctcgaggtctaagaaaatctaatctccaacattgaagtttcagctctaagaacatctaagatatgcatcctaaatgtcattacccagaatgtctataatcttcatcaaacctgatatttctacattaattaattcctaacattactggaatttgagcccaaggttggggggaaatcactaataaagtcacaacagaaagatgccctgttttattaaccaaatgcatctgaccatataaacaattgttgacagtcatttcttttctacctactcacattggatgtgcttgaacatctgctttctgccctttaaaataaaaggcctctcttacaacatcagtggctattagaataggtgagctgcagtgctagcaatagctttgttcttcttcttatcactgcttttgccttctgtttgccaccattagtagcctttgcacataaagcctattaatttctctacagtaagtaaggtggcttgactagtaataagtggcatcaaaatgagctgatttttttaacatgtccagattctagtctggctccaataaatatcaaataaatcatgagacaaatgtcatagacaactcctttttcacttcctatgtcgtgtataagtacatgaaaaatccattcaacagtcactaatgaatgctattaatagataaaatgtcatcaggcaaaagcagagctcagtaacagtacttacaaaatagtcctggattctgaagcggctctctggaaaatctatacccacccccccaccaaatctacataaaatactgttcttacatatctattaaagtgtttcttgaggtgaggggctgggaagggaaaagtaagggtagcgagcaggagaaacggagatctgtttgagctcagcccttcttctagcctcatgttctttcctctccatctcctacacttgttacttatttattagggagagcattacaaataatgtcagacttcctggtagttgcctacagccctgtgatactgcgtataatttgtattccagcattgaagtgtctaacgtggtagaaatgaggagtagcttcctgacacacggactgtgagtgcagagatagtgaagggggtgtagctgaagagcacagcactagctgtctcttggctcctgctgcttcttttattgcctttcccccttctagcttgttcatgccaatatttatccatccatccatccatctatgatctttccatccccttcacacaacttattgtgtacctgtgtgtgtatatcatggtgccagtgaccacaatttgacttaagctcagcatatcaaaatctgtagagagcaaggtccaggaatttgtataattaatcaactctaaagatgattctgattctcagacctgtctgagtaccgcttatttagcagcttcaaatatgtttgacctggattgctaccaccaaggaggtccccctttgactttttcttatctgctgctaaaaccttatcctgattattttcttctcttacaaatgtaacacaaaaggaaaccaataactaatatgtctaaggtttttgccaacatttataattgaaataaatgctaaaattgagttagaggttagtgaaaagaaaaatgtacttttttccccaccatgttcatgggtcccctgaattccatccacaagccccttgggtgcctatggaccccaggttgagaagtactgtaaacaggaattttacagcagtgctgtgcagcacaaaaggcaccaacccatcctagaatcaagcagtcttaagtttagatcccagctccagaatttactcgctatagaacgttcagctagaaggtacttaacttctcaatgtcttcattttgtcttttgtctttttttttagctctaaaatggaattaaaagagaattagtaacaataatgtcttataagtttctaaatttaattagataacataggtagtatcttggaacattatgaatgttcaaaattaggttcagtatatattattcacctttccccatgttaatctaaattacctgaaggatccttaggcccagaaaatcattattgtatgaactcactttaactgtatcagctagtcatgttttcagttgaaattactatgtattaatcacattttcaaatatgtgtatgcatgtgtgtatgtatgaaatgaccctaactctgcaatttgtgaatctgtataaatccaccaaatatccagatcccaaccaagcctcaaaacctttcaaagaccctttttaaaagtgttgatttggccaaaaaaatgactgtcttcaattctccacctttagtttgaggcttaccaattaaatgtccctcctctgtgatgtgattttaaagtcagcagtaggccaggcagggtggctcacacctgtaatcccagcactttcggaggcagagacaggtggatcacttgaggccaagagttcgaaaccaaactggccaacagaatgaaaccccatctctactaaaaatacaaacaatagctgggcatggtggtgcatgcctgtaatcccagctactccagaggttgggacaggagaatcgcttgaacctgggaggtggaggttgcagtgagccgagatcacaccactgagctccagcctgagcaacaaagtgagactctgtctcaaaaaaaaaaaaaaaaaaaaaaaaaaaaagtcagcaatgaatgctagatactgcatccagtctctgcagatgctcaaggctgctcaatttgtctagatgattacactgcccaaatgcacacatgatgctcgacattcatctaattgcaggcagccaatctgaattcctcacatgtaggccattgatgactaaatgtatccagagatctggatttacagagaatattttctcataacaacacttaaatctcaaagaattgtttacacccagactctagtcttaacctatcttgtactgtgcagaggaacaagtatgtacaggatagtaagcactgtgtaatttaatttggtagaaaggggaagtgtgatttttatgctgaaagaatactagtttttgtatcacacatacacacacacacacacacacacacacaaatactcatgaacacacattgagcttaacaaaaatttcaaggcaccattctgaaatctgtccattagcacttcaagtgtgattttattcatacatgctggttctcctgaaaaaggtggactttatctcacaagtattttagactaacttaaagacagcatgaagtgctctctgattccatttgtttagagaacaatagcccctctgtgatataacaggaattggatgaaaatatcttctacctattgtttcttctgtatgtgacttgatctttattctctgtaaaaagcagaatttctttgtttccgagaaggatctctcctcaggaggattaaaactcttttcttacagctctttagcagaaatcactttcatagctaaacaagagcatagtaaatggattttttccagaccctaaaacttacataaatgggctctcttgttcacccaaaggtcaggaaaatgcagtctgcaaataacaaatggtagaaatccacataatagactccttggtcataggtgaatttagcagcaggcacttttggaaaatgtgtacacatgtaagttaaaagaatgattctaccaaaatcttgcagatgatgagcagttaaaataatgttgggaaaaaatgactcatcctttttatacttgagatgaacgatgcaaaatggagtgcccttccattgtttacctgtgtctcctgccagacagtgacctccctcagctcgcagggccttacttattttttctcatgtctggcagagagtctcatatatggtagactttcaataaatattagtggaaaatgatgaacacataaatgaattaaaaattgtaaccagcaatgtctaaacaaggtaaaaacaactataatgttatgggctaaattgtatgccccagaaactcatgctgaagtcctaaccctcagtgactcagaatgtgaccttatggaaaggagtctctgaagacaataattagttaagatacggtcacagtggagtagagtgagcccctaattccatgtgactattgttattataaaaaggggaaatttgtagaccgaccctcacacaaggagaatgccatgtgaagaatggagttatgctgccacaaattaatgaactgccagatgctagacatggaacagattcttcccaaagtgcttttcaaatatgaactcacttaattctcaaaatgacccatgagggtggtgttattgtagtcattttacaagtgtgaaaactgagacacatgaagaagttaaaaaatgtgcccaaggtcacacagcttgtgagtgaaggtggacctcaaatccaagcagacaattcctcatgatgtgagaaaagagaccttatcagttccttgcagcaccttgcagagtttgggggtaaactctatcagatctgtaaagctatgcatctcctgttgggttgccgatatttaattgcagctccactattagaaagtaaaaataggccaggcgtggtggctcatgcctgtaatcccagcactttgggaggctgaggtgggcggatcatgaggtcaggagatcgagaccatcctggctaacacggtgaaaccccatctctactgaaaatacaaaaaaattagctgggcttggtggtgggcaccagtagtcccagttaccctggaggctgaggcaggagaatggtgtgaacccaggaggcggagcttgcagtgagctgagattgcaccactgcactccagcctgggtgacagagtgagactccgtcccccccaaaaaaaaaacaacaaaagaaagtaaaaataaaagtagaattatgcctaatagttcaaagattggtgaatagttcaaaatgtttcttttcacccatgacccttttcaccttgatctcagacttctggcttgcagaactgagataataaattgttgttgtttaagccaatcagtttgtgggcattttgttttttacaacacatagccctagcacactaatacacatagcaattaagaatttggaagtaggaagagtaccaaaaatgttgaaaggaaaggagatatcaagaaaacattgctaccagaggcagtgtcctaaccactaattaggatggaagaactggactataatgcctttggaagaaataggcccctgacctggagtcaaggcagtaaccagatggggactcacaggaccaaggtgtccatcaaagggggttgaagatcaaatagcacatgagggcctgctttgaggttggaattagagctggttaaatgttttctttatcaagtttaaattgttgttgggactggaaatggaggggaattgtatgtggagatctagagaatatgaacatagtgaggagggatgcataaactaggaagcagtctgcccaaaataatttcatcatgtttggagcatatttcctacttaaagtaataatcagcagagttaacagacaacccacaaagtgtgagaaaatcttcataatctatacatctgacaaagtactaatatctacagtgtacaaagaactcaaacaaatcagcaagaaaaaaacaaacaattgcatcaaaaagtaggctaagggcatgaatagatcattctcaaaagaagatatacaaatagccaacaagcatacggaaaaatgctcaacatcactaattatcagggaaatgcaaatcaaaaccacaatgtgataccacctaactcctgcaagaatggacataatcaaaaaatcaaaaaatagtaaatgttgatgtggatacagtgaaaagggaagacttttacactgttggtgggaatgtaaactagtataaccacaatgaaaaacagtgtggagattccttaaagaactaaaagtaaatctaccatttgatccagcaatcccactactacttatctacccagagaaaagtaagtcattatataaaaaagatacttgcacatgcatgtttatagcaacacatttgtaattgcaaaactatggaatcagcccaaatgcccatcaatccaccaacgagtggatagagagaaaatgtggcatatatatagtatgcaatactagtcagccataaaaaggaacaaaataatggcatttgtagcaacctgggtggaattggaggctattattctaagtgaagtaactcaggaatggaaaaccaaatatcatatgttctcactcatgagttggagctaagatatgaggacgcaatgcataagaatgatacaatggaatttggggacttgggggaaagactgggaggtgggtgagggataaaagactataaattgggtacagtgtatactgtttgggtgatggatgcaccaaaatctcataaatcaccactaaagaacttattcatgtaaccaaacactacccgttccccaaaaaacctattgaaataaataataaataaacaaacaaataaataaataaaaagttaaattggccatactgcatatgcaatgggattataattttgtatatgccagtggttgattctgccaattattactcgtggaggggttcatgcaagaccctctgcaaagcattgtttgtgatacaaagtattctaggactctggagtaagaccaaagaccaagtctaccactctgccacttatctgctgtgatggaattcccttctagtactgaattttatgctatgacctcagatctatttctaaaaggaggaattcccagtacacagaactaaaatcatcatgtagatctgcagacatacagcctgcaccttccagggattttctctactataaattcactacggagaatttcggtaaagccatgtttttctttaaaaacaatatcagtggcagccaagatggccaaataggaagagctccggtctacagctcccagcgtgagtgacgcagaagacgggtgatttctgcatttccatctgaggtaccgggttcatctcactagggagtgccagacagtgggtgcaggtcagtaggtgcagtgcaccatgcgcaagctgaagcagggcgaggcattgcctcactcgggaagtgcaaggggtcagggagttccctttcctagtcaaagaaaggggtgacagacggcacctggaaaatcgggtcactcccaccctaatactgcgcttttccaacgggcttaaaaaacggtgcaccaagagattatatcctgcacctggctcggagggtcctacacccacggagtctcactgattgctagcacagcagtctgagatcaaactgcaaggcagcagcaaggctgggggaggggctcccaccattgcccaggcttgcttaggtaaacaaagaagccgggaagctccaactgggtggagcccaccacagctcaaggaggcctgcctgcctctgtaggctccacctctgggggcagggcacagaaaaacaaaaagacagcagtaacctctgcagacttacatgtccctgtctgacagctttgaagagagcagtggttctcccagcacgcagctggagatctgagaacgggcagactgcttcctcaagtgggtccctgacccctgacccccaagcagcctaactgggaggcaccccccgataggggcagactgacacctcacacagccaggtactcttctgagacaaaacttccagaggaatgatcagacagcagcattcgcagttcatgaaaacccgctgttctgcagccaccgctgctgatacccaggcaaacagggtctggagtggacctctagcaaactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagagcagaaaaactgggaactctaaagagcagagcgcctctcctcctccaaaggaacgcagttcctcaccagcaatggaacaaagctggacggagaatgactttgacgagttgagagaagaaggcttcagacaatcaaactactccgagttacaggaggaaattcaaaccaaaggcaaagaagttaaaaactttgaaaaaaatttagacgaatgtataactagaataaccaatacagagaagtgcttaaaggagctgatggagctgaaagccaaggctcgagaactatgtgaagaatgtagaagcctcaggagctgatgtgatcaactggaagaaagggtatcagtgatggaagatgaaatgattgaaatgaagcgagaagggaagtttagagaaaaaagaataaaaggaaatgaacaaagcctccaagaaatatggaactatgtgaaaagaccaaatctacgtctgattggtgtacctgaaagtgacagggagaatggaaacaagttggaaaacacagtgcaggatattatccaggagaaattccccaatctagcaaggcaggccaacattcagattcaggaaatacagagaacgccacaaagatactcctcgagaagagcaactccaagacacgtagttgtcagattcaccaaagttgaaatgaaggaaaaaatgttaagggcagccagagagaaaggttgggttacccacaaagggaagcccgtcagactaacagtggatctcttggcagaaactctacaagccagaagagagtgggggccaatattcaacattcttatagaattttcaacccagaatttcatatccagccaaactaagcttcataagtgaaggagaaataaaatactttacagacaagcaaatgtggagagattttgtcaccaccaggcctgccctaaaagagctcctgaaagaagcactaaacatggaaaggaacaaccggtaccagccactgcaaaatcatgccaaattgtaaagaccatcgaggctaggaagaaattgcatcaattaatgagcaaaataaccagctaacatcataatgacaggatcaaattcacacataacaatattaactttaaatgtaaatggacttaatgctccatttaaaagacacacactggcaaactggataaagagtcaagacccatcagtgtgctgtattcaggaaacccatctcacgtgcagagacacacataggctcaaaataaaagtatggaggaagatctaccaagtaaatggaaaacaaaaaaaggcaggggttgcaatcctagtctctgataaaacagactttaaaccaacaagatcaaaagagacaaagaaggccattatataatggtaaagggatcaattcaacaagaagagctaactatcctaaatatatatgcacccaatatgagagcacccagattcataaagcaagtcctgagtgacctacaaagagacttagactcccacacaataataatgggagactttaacaccccactgtcaacattagacagatcaatgagacagaaagttagcaaggatacccaggaattgaacccagctctgcaccaaggggacctaatagacatctacagaactctccaccccaaatcaacagaatatacatttttttcagcaccacaccacacctattccaaaattgaccacatagttggaagtaaagctctcctcagcaaatgtaaaaaaacagatattataacaaactgtctctcagaccacagtgcaatcaaactagaactcaggattcagaaactcactcaaaaccgctcaactacatggaaactgaaaaacctgctcctgaatgactactgggtacataaagaaatgaaggcagaaataaagatgttctttgaaaccaacgagaacaaagacacaacataccagaatctctgggacacattcaaagcagtgtgtagagggaaatttatagcactaaatgcctgcaagagaaagcaggaaagatccaaaattgacaccctaacatcagaattaaaagaactagaaaagcaagagcaaacacattcaaaagctagcagaaggcaagaaataactaaaatcagagcagaactgaaggaaatagcaacacaaaaaccctttaaaaaattaatgaatccaggagctggttttttgaaaggatcaacaaaattgatagactgctagcaagactaataaagaagaaaagaaagaagaatcaaatagacgcaataaaaaatgataaaggggatatcaccactgatcccacagaaatacaaactaccatgagagaatactacaaacacctctacacaaataaactagaaaatctagcagaaatggataaattccttgacacatacaccctcccaagattaaccaggaagaagttgaatctctgaatagaccaataacaggctctgaaattgtggcaataatcaatagcttaccaaccaaaaagagtccaggaccagatggattcacagcagaattctaccagaggtacaaggaggaactggtaccattctgtctgaaactattccaatcaataggaaaagagggaatcctccctaactcattttatgaggccagcatcatcctgataccaaagccaggcagagacacaaccaaaaaagagaataccaaagcctggcagagacacaaccaaaaaagagaattttagaccaatatccttgatgaacattgatgcaaaaatcctcaataaaatactggcaaaccaaatccagcagcacatcaaaaagtttatccaccacgatcaagtggacttcatccctaggatgcaaggctggttcaatatacgcaaatcaataaatgtaatccagcatataaacagaaccaaagacaaaaaccacacgattatctcaatagatgcagaaaaggcctttgacaaaattcaacaatgcttcatgctaaaaactctcaataaattaggtattgatgggatgtacctcaaaataataagagctatctatgacaaacccacagccaatatcatactgaatgggcaaaaactggaagcattccctttgaaaactggcaaaagacagggatgccctctctcaccacacctattcaacatagtgttggaagttctggccagggcaattaggcaggagaaggaaataaagggtattcaattaggaaaagaggaagtcaaattgtccctgtttgcagaggacatgattgtatatccagaaaaccccattgtctcagcccaaaatctccttaaactgataagcagcttcagcaaagtctcaggatacaaaataaatgtacaaaaatcacaatcattcttatacaccaataacagacaaacatagagccaaatcatgagtgaactcccattcacaattgcttcaaagagaataaaatacctaggaatccaacctacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaatagagcccttggaaataatgccacatatctacaactatctgatctttgacaaacctgagaaaaacaagaaatggggaaaggattccctatttaataaatggtgctgggaaaactggctagccatatgtagaaagctgaaactggatcccttccttacaccttatacaaaaattaattcacgatggattaaagacttacatgttagacctaaaaccataaaatccctagaagaaaacctaggcattaccattcaggacataggcctgggcaaggacttcatgtctaaaacaccaaaagcaatggcaacaaaagccaaaatggacaaatgggatctaattaaactaaagagcttctgcacagcaaaagaaactaccatcagagtatacaggcaacctacaaaatgggagaaaatttttgcaacctactcatctgacaaagggctaatatccagaatctacaatgaactcaaacaaatttacaaggaaaaaacaaacaaccccatcgaaaagtgggtgaaggacatgaacagacacttctaaaaagaagtcgtttatgcagccaaaaaaacacatgaaaaaatgctcaccatcactggccatcagagaaatgcaaatcaaaaccacaatgagatatcatctcacaccagttagaatggcaatcattaaaaagttaggaaacaacaggtgctggagaagatgtggagaaataggaacacttttacactgttggtgggactgtaaactagttcaaccattgtggaagtcagtgtggcgattcctcagggatctagaactagaaataccatttgacccagccatcccattactgggtatataccgaaaggactataatccatgctgctataaagacacatgcatacgtatgtttattgtggcactattcacaatagcaaggactttgaaccaacccaaatgtgcaacaatcatagactggattaagaaaatgtggcacatatacaccatggaatactatgtagccataaaaaatgatgagttcatgtcctttgtagggacatggatgaaattggatatcatcattctcagtaaactatcagaaggacaaaaaaccaaacaccgcatgttctcactcataggtgggaattgaacaatgagaacacatggacactggaatgagaacatcacactctgggtactgttgtggggtcgcgggagtggggagggatagcattaggagatatacctaatgctaaatgatgagttaatgggtgcagcacaccagcatggcacatgtatacatatgtaactaaccttcactttgtgcacatgtaccctaaaagttaaagtataataataataaaaaataaaataatataaaaaaataaaataaaataaaaacaatatcaccagagagatgtcttgtttatttccacttgtctacatgagaccaagcaggggactaattcctgtcctctgcagggcacagaggatagtgcgtgatgaaacgtagtgatgaacaacatggtccactgatgaccctgcccaaaatcataactagaatatttcctaaaacatatattattctttcactactttgtacatcacgtatttagtttgttaaatcttttacttcaaaggatagattttctttttgttaatttgtgcacatatgcatttgtgaagatttagaatttatggatatttgttataatgtatttcaagcgaatagaaaatacaacatatacccttgtatccaaattgaataaatgttaacatttgccatttttgtttcaggtatgttttaataaacttgactgataccattaaagcagccttgcatcttgttttctccattacccctcaagttggggtgtgtccttctcctcatgtgcttatcttattaatgtatatggaattacatgtagattacagattttttaaatttttgtgtgtctatttactatatttttcactcattatcagttttcttgtttcctactttttgtgggactgatcaactttcttctctactgtcttcatattctttctgctagttaaagattatatatctatttctcatctttcaatagttattcttttctggtttttttttttttttgagacaatgtctcactctgtcaccaggctggagtgcagtggctcgatctcggctcactgcaacctccacttcccgggttcaagcaattctcctgcctcagcctcccaagtagctgggactacaggtgcatgccaccacactcagctaatttttgtatttttggtagtgatggggtttcaccatggtggccaggaagatatatatatataaaatacatacatatatatatatatatttgaaaactcatgctctatatgataaatacatacaattttatcaattttataaaaatgatttattgtttaaggtataaaaatgagattgtgattatgttaaaaataggctatatgttttagaatgaatactggaatagttattaataaaaaaagaaaattattttcaaattttaaaaaagacatatacttgattttaaaaagttaaactaatttaaaattttatcttctttttgaacacaataaagtctttatagcaatcatccctcaccaatttttcatgttaattttgtctagtttttaggtctcccttatttattaggggcacaacttaaaaaatatttttatagcagctgattactttgatgtgtccacgtgcttgtcaatgtctttggtcactattctaacatactactttgggttctattttcctattcctgaagaacatgctttagtagttgtttcaccaaaaacttgtgaactctttagtagctttttgttactccgaatgtctttatttcagtctcattttataatagtagttcaactcaatagttattctagtgtaacactattttcttcagtgcatcatcatctggtgtctattgttgctgtctgatgttatcaattgcattaggttggtaagcattccctatcaggggaaaccagcccctgatatttcaacgtaggttcttttctattttccctaagtgtcgaccggtctgagaaataaggggaaagagtaccaaagagagaaattttaaagctgagtgtctgggggagacatcacatgtcagcaggttccatgatgccccccaagccacaaaaccagcaagtttttattagtgattttcaaaggggagggagtgtatgaatagagtgtgggtcacagagatcacatgcttcacaaggcaataaaaaatatcacaaggcaaatgggggcagaccgagatcacaagaccagggtgaaattaaaattgctaatgaagtttcatgtcccactgggcatgcattgtcattgataacatcttatcaggagacacggtttgagagcagacaactggtctgactaaaatttactaggcaggaatttcctcatcctaataggcctgggagcgctacgggagaccagggcttatttcatcccttatctgcaactgtataagacggacagtcccagagtggccattttagagacctacccctgggaatgcattctctttctcagggctgttccttggtgagaaaaagaattcagtgatatttctcctattcgcttttgtaagaagagacatatggctccgttccgcccagctctcaggtagtcagacctaatggttatctcccttgttccctgaacatcgctgttatcctgttcctttttcaaggtgcccagatttcatattgtttaaacacacatgctttacaaacaatttgtgcagttaagcaatcatcacagggtcctgaggccacatacatcctcagcttatgaagatgacaggattaagagattaaagtaaagacaggcataggaaatcacaagagtattgattggggaagtgataatcttcacaatttatgtttagagattgtagtaaagacaggcataagaaattataaaagtactaatttggggaactaataaatgtccatgaaatcttcacaatttatgttcctctgccatggcttcagccagtccctctttttggggtccctgacttccctcaacaattcccaaaagcatgtgtgtatgaagaaaatacttgactcacagtttcataggaaaacaattgtataggttcttaagtggttacactactactgcatttatcttatcaaaataattcaaattccattaaaatgtacatatattgaatgcatattgaaagccagggattttcataaatttatcccatttattctcacaatcttaggaaactgttttaatatctctacactttacagatgaggaaactgaagcccgtggtggtcaagtaatttacttttgatcacacagctgagaaacggcatttgcctgaggtaacctaggtcttctaattctgaatccagtagagttgcctctagagtcaatattatgtattttaatcccctcacttatttttatgacagtgaaaggagatagaataattgtaattaagatcagaggcactggtcactctcatttaagaatcgcatggtttatgaggaaatcttcctcacagggtccaaggtggaagtcagaccttgaagccccaacatgcccctgaggactgagcaagccgctcttcttcaaagcctgagagacaggaactcagctgcttgcttgcataatcatattcatgagttttagattctgggtagtttccttagctgcacgttgagaaattgaaaaatggcaaaattaaaaataaatgacttttgtaatacagaaaagcctttactctggagaaaaatgtaattcagttttcaggcacattccacttcttttatgatttgaggatatcacaaagcatgccagcaagtctaaggggatgtatttggaggagtaggtcatttctcaggtaaaaaagtgttttatttatggtgtgcaagcatgggaatgagaaggtctgggtttcagcctggacccttgatctgattcgctttaaggacaaccacaagtcacttagactccatgggcttcagttttttcatttgtaaaatgtaaaagtcaaactagatatctcttttaataggtgagctgaatatgtttccatttattggagaaacctcaatctttttatgttttatttaccatattatgtatgcatgattgtaagtatgtaggtagaaagtttttttttttttttttgctttcttttttcccttttcctgacttctgttaaactgatattgatttaaatcttcctggtcttaatgtttgtatgcctgcatgtaggtatgtatttgccactcacttgaaaaatgtacctatattttcttctattaaagattacttttaatttcttcctaatctttaaattaaactttaaaaatataattggattcatgtacagctgtaggaaattataaaggaagagcttgtgtacttttaccttgttttccccagtaataactatatcttgccgaactatagtacaatattacaaccaggatattgacgttattgcagctaacatactgaacaatttcatcagcacagggattccttctgttgctcttttataactatatccccttcctcctttccttcccaaccccacccttgatctctgacaatccctactctgttctctgttgttatatgttgtcatctcaagaattttttacaaatggactcatacagtatgtaaacatttatgattggcttttgtcttgcagcatatatcaatcattcatttttattactgtactggtagtattccttgatatgggtgtaccatagcttatttaaacaattgcctgtgaaaggacatctatgttgtttacagttttgggccattacaaataaagctgttatgaacatttatgtaaaggtttttatgtgaaaaaaagttttcatttctctgtgataaatgcttaaaagtgtaatttctggatactatggtatttgcatatttagttttaaaataacttgctagactgttttccagagtagttgcaccattgtacattcccaccagcaatatatgggtgatctagtttctctgcatctttgccagcatttttcattattgtcattatttctttattttaaccattctcataagtacatagtaatatatcattgtggttttaatttgcattttctgatggctaacaatggagaatatgttttttgtgcttatctgccatcggtgtatcctctttggtaaaatgtctatttgtgtcttttgccaattttatatttagatttttttgcttttcttactgttgaattttgacagttctttatattttctagatacaacttatttgctgaatatgtggtttgtaaatattttctcaaagtctgttgcttctctcttcatcctcttaatagggtctttcccaaagcatttttccttccatggatcatgcattgcatgtcaagtctaagaagtctttgcctagctatagacaccaaatactttctcctgtgtttttttttccctaaagcttttatagttttacattttacatttaagtccatgattcatgtcgagcaaatttttgaataagaaaatttaggtcaagctttatttttgcccatggatatctaatagttcccacacaatttgtgaaagaactatttttctacattgaattgcttgtgcacctttgtcaataatcaattgggtatagttgtgtgaatctatttctggattcccctttttgttccactcttctaagtatcaatctcttcatcagtaccacactctcataactacaactatacagtaaatcttaatattgggttgaataattctttccactttatttttttggaattgttttacatattttaggggctgtgcattttcatatatattttagaagaagcttatttatgtcaacaaaatccctgatgggatcttgttaaaaattgcatcaaatctacagatcagtttgggggaaaatgatatctttactttcttgagtcttccaatggcatgtatgtatgaacatgatgtctctttactaatttagaacttttctttctttcattgacattttataatttacagcataaagattctgtatatgattctgtgcatattattctgtaaccttgcttcactcacttattagttctaggagagtttttttttaattcttagaattttttcatatagacaattatgtcatctgcaaatagaaatgattttatttcttcctttccaattggtatgctttttactacactcaatttttagatttctagagaaatatacatttcttaatgaagactaaatttattcaatgctattttcctccctgaatgataagatgatgtcacactttaactgcctcatgttattgtttcttagagtttttgttctacctgctttaaacacacacactaattttggttaatctttttaataaaatcaatagttcattaaaattattgacacatcttatcagtttctgtgtttgttatcttttcttgtaacaggtactttcctctaggttcatttttcttgttgctgaagtagtacctttactaagtgttttgtttattaattgaaggcctaaggcctcattcttctccacagtgatatccaattttcctggcaccatttattaaaaagggtgtgtcctttcccattaaatgttcttggctccttttttgaaaatcagttggatgtaaatacaaggatttatttatttctgggttccctattcctttctattggtctatgtgtttttataccagtatcatgtgactttggttattatagctttgtagtatattttgaactctgttaatataacgcctgcaacattgtcctggcactcaggattgttttagctgttcagaatcttttgttattccatacaaattttaggatttttttttatctctgtgaaaaagtcattggtattttggtgatgctattacattgtatctgtagactgctttcactttacgtctgtgtgtttcttcattggtcagtgagcttcttgtaggcagcatacagttgagtcttccttttttttttttttattaatccatttggccagtctgtatattttcattggggaatttaatccatttacatccacagttgtttttaatagatgaggacttccttctattactttgttggtagttttttggttgttttatatactctttgttcctttcttccactcttgtttgtgtttgtgatttggtgcttttcatagtgataacattttattcctttttcttacctcatgtattttctctaccagtaaacttcataactgggcacgttttcatgagagtagacaatgtatttttgcttcctgatgtaggactcccttaagcatttattgcagggccagtctagtggtgatgagttccctcagtctttacttgtctgaaaaaggctttatttcttaaaaatagccttgctgtatataatattcttgactgacaggtttttcttttagtgctatgaatatatcatctcattctgtccaggtctgtaaggtttctgctgagaaatctgttgttagtctaataaggattcccttacatgtgacttgatgtttttctcttgctgttttcagattttttctctgtctttgacttttgatagtttgactatattgtgattctgagagaacttctttggattgaatttacgtaagaatcttttagcttcctatatctggatcttcatacctctcccaagacttggggagttttctgctattatcttgctatatgggtttttaatgcctttccccaccttcttcttctggaattttcataaggcaaacattctttcacttaattatgttctgtatgtctcataggctttttttttcattcttttaatgttctatttctttttaaacattaacaatttggttatttcagacctaatagatatctacagaactctccaccccaaatcaacagaatatacatttttttcagcaccatgccacacctattccaaaatcgaccacatagttggaagtaaagctctcctcagcaaatgtaaaagaacagaaatgataacaaactgtctctcagaccacagtgcaatcaaactagaactcaggattaagaaactcactcaaaaccactcaaatacatggaaactgaacaacctgctcctgaatgactactgggtacataaagaaatgaaggcagaaataaagacgttctttgaaaccaacgagaacaaagacacaacataccagaatctctgggacacattcaaagcagtgtgtagagggaaatttatagcactaaatgcccacaagagaaagcgggaaagatccaaaattgacaccctaacatcacaattaaaagaactagaaaagcaagagcaaacacattcaaaagctcgcagaagacaagaaataactaaaatcagagcagaacagaaggaaatagagacacaaaaacccttcaaaaaattaatgaatccaggagctggttttttgaaaggatcaacaaaattgatagactgctagcaagactaatagagaagaatcaaatagatgcaataaaaaatgataaaggggatatcaccaccgatcccacagaaatacaaactacccatcagagaatactataaatacctctacacaaataaactagaaaatctagaagaaatggataaattccttgacacatacaccctcccaagactaaaccaggaagaagttgaatctctgaatagaccaataacaggctctgaaatttaggcaataatcaatagcttaccaaccaaaaagagtccaggaccagatggattcacagccgaattctaccagaggtacaaggaggaactggtaccattccttctgaaactattccaatcaataggaaaagagggaatcctccctaactcattttatgaggccagcatcatcctgacaccaaagcctggcagagacacaaccaaaaaagagaattttagaccaatatccttgatgaacattgatgcaaaaatcctcaataaaatactggcaaactgaatccagcagcacattaaaaagcttatccaccatgatcaagtgggcttcatccctgggatgcaagtctggttcaatatacacaaatcaataaatgtaatccagcatataaacagaaccaaagacaaaaaccacatgattatctcaatagatgcagaaaaggcctttgacaacattcaaaaaccttcatgctaaaaactctcaataaattaggtattgatgggacctatctcaaaataataagagctatctatgacaaacccacagccaatatcatactgaatggataaattcataaattctttatcctgcttgatctagtctattgtggaagttttcaattgcattcttattccactcattgaatctgctgttccaatatttcaatatttctgtttgattctgttttatatctatctctttgttgaatttttcattgagatcatagttttcaagattttgttgaattatctatctgtactcccttgtttctcactgaatgtccttaagattgtcattttgaattccttttcaggaatttcatagatttccttttctattactgaagagttattgtgttcctttgagagtgtcatgtttccttgctttttaatatttcctatgtccctacattgacgtttgtgcatctggtggaacagtcacttcttccaactttatggagtaactttctcaggaaatactttttcctgtagatgtgtcctatggagttgattgggtatggtgctttggcattggttctgggtaggtgcagtagtgtagtctttgtatgatttgttcagctgtaataaatgtcagtggtgtatacaattgtctccatggcctaggctgtgattgtttgtgaaggctgtggtatggctttgctaagttgtgctggttcttgggttcttggggagtgcataagcatgcagcaactctgccttgggagaaggtaggctcactgtggcaacagttgtccccaggagggttggttctcaggctactgggaggtatatacattggcagttctacctctggaggcagtttggccatggcagctcttggttctggggagtacatacattagctccttctgctctgggggaagcctccccactatgctggatcacttgtgcgatcagggtgtagagtgctatgtgggcttggtgctggggtcagcgctgtacaattgagttcagctggtatcaagacacttcagccctcagagtggatatgggggagtgtcagcaggacttcaattatgtggagatgcagggactaatgagccccacggcaggatgcattctggtggtggctccactctcaaaatggcaccatgctgtagcaactgtgtcagaaatcccacagaattttctccctggaaagatgtagacacatggattccaggcagctccctagtctgggctcaggacctgcaagagttgtggggcttttctgtaggtagggttgcaggcatccatggtaggaatatagacttctggggatctcctgattaccttctcctcacaatggggagcctcttttggctccaagccattctcccagccaggtgctttgcttccctctctgtgctgagtttctgtgcctcagagggtctttgtcacttatttgctgaattccagtgttctcccttagacatactatttgatgtgtggttatctatttgttgttttgatctttttttgtggaggaggtgagtgctgcatgcctctagtcagccatcttgatgaccaattaaatgtgcacagtttaaagttcttgtcacaaccatcattttttaaaacttgaaataaatgtgtgttccagttgttgattttgttgactttcttactaagagagcttcatattgtgaactttccatatattttcaaattttagctgttaaatttgtttcgagtgggaagttttagtttttccctctttttcctcccagattcaccttcttctggtctggcattcttggcagcttccagtatccacccaccttcactgactctaggctttcagttgagaaccaggtcttacagtgatttttcagagctctctgcctctgatattgtggctatcacaaaccaatcaccgagccaacaggcatcttggttcagttctatggggatgaatgcttgttctatccccccagaacctctgagagcatcttgtgaagtcacaatttcaggaagcaaaaacagagccattctccccttttccacataagaaaagtgcctctacctcagttccaggcttcattgagcctgtccttagtattttttgtgaaagcactatccacatttctctctaaagattaaaactttcacagccactgctggctcacagaccagggtccagcaggtctgaggcttcattttcatttatcgtttttgtgtttctttcctgtttttgattgcatatataactcatcttttaaacccatcagtgcctttctgcatggcctcttttaatattttattgctgtatatttgaagtaaaagaagtatattagaatgtgaacggtactgcttgaaacaaaacctgaactagcactaatatcattttatctgtgtgactttatgatagagctttatcaaattgcctggatatacatacacacacaaacacaattagttaatgtaaaagctggagaaaactgcatgtgctccataataattaatagtattgtaccaatatcaattccttgtttgatatttacaacagttatatatgatgttgcagaggggaaagccaaatgaagtgttcccaggattcaatgtactatgtttgcaactttctgtgagatcgtaattatttcaaaagaaaaagtttcaaaactaaggttatatagttatacaaatatcaaattgcttttatcatttttcattcaagaactaggcagttctgaggaaaaacaaatgatatgccatataaagtcatttggccctgtacatgatgcatggaaagcattaattaaattttattttatctcctttcctagtaatcatatttctatgccaacttttttttcccagtgtgatctaccttgtgtcttgtttgttcatttatttgttcacatagcaaattcttttgaagcaccaattatgtgtcaagcactacattaagccctggaatatcaaagattaataagatagaatttctttatccaaggttcttctaatctattggaaaggaaaaaacatgtaagcagctacaaaataatctgataattatatgaagtaagtgctgccagaacacagaagagggaacatttgtctttgtgactcagttacagcatcccagagtatatacaggctagatcctaaagggtaaggagggatttttcagaatgtgaggaattttatgggataactggcctgatttcttacaaatgaatgatatgaataaaaagcatgctgggaagattgctacagattaaaagatacttaagaaggaaatcaaccaaatgatagtcatcatttgaataaaacaactgcaaaaagacattcatggtataatcaaagaaatttgaaaacaaattggatggatagtaagaaattattgttaatactgagtaatagtaatggcatgcccaaagatataatattgttaataatactgggagttacagaattatcgttatatatatatatatatacatatatatatatataattgttatttttgttaggcacaataacagtattgttatttaacttatatcctttatgtcagagttacaaactgaagtattcacaaataaaatgatatgatgactgggacttgccataaaatgctctagaaaacaacattgtggaagatagatgacatatgatgaataaaaagtgactaaatcttgaacttggtgtatgggtgaatggaaattcattaacactgttctccctgtgctaattctatgtttggaaattcccataataaaaagtaaaatttattccacaatcatcaacattttacgtagcagattcagattatttagcgcctaatcttcattttaatttattctgagtcatagatagcattgattaattgtctcagtcatggtagtaatattttcttctcagtcatagtctcttgtatttcagttaggtaccagccatgtcatcaggaattaaaaaaattttagtgaagttatttgtgtttcctctgtgcattggatgaagatgacatttttttcagagaaattactgggaaaaaaaaatcactctgccttctttaacattccatgtgtgagtgattttatcggctctgaaattgtaaacccacacttttgactctgggaataagctgataagattttaaaaccttctacccaaaagactgcacaataatttttttaaaaacttcaagtagtctcaataaatacattttgctttttaaaaataagcaaaatataaaatgtttggagctaaggatgctggatgaaggaagaaaagaaaaatcactccaggcagggaaagcagcaaattttttaacaaaaagcttatgttaggaaaatgttgaaatattgactggaaaactgggaaccaaggtggggacagtgaggatatgaagctgaaagatagttaggaaccacatgactaatagtatttccaaactaacaagttcttccccacaaagaattttactgtttaatccctataggcaagagataaccaatgcagatttgcaacgaaggaataacagagctgtgtttgttttgtatgtatctcaggtagtgatatggagtatggaataaaggaagaatgagctggcatcaggggaatcaatgaggaaccttttttaatagtataaacaatagacaatgagggctaaactacatcatggcattgagaatggaagtaaatgctttgtctgcaactaattcagttaagacttcgaggctcactgtaagaggtgggaagaagaggaacatattacttgatggtaacatcattaaccaagtgtgagaatatggaacttagagtaggcttggggagggaggacgtaatgagcacagtattagacatgttaatcatgaagctctataggacaaccaggcagagctcatggctggaggctagctgtcctttgctgaagcaaaatatattgtctattgtagaatgagaagaccgaaggcaaaactctggtgaaccgacaaactaatatgtgaaagaacttgtaggctgaaagagtaatgggcagagacgaggagaaccatagtaaaatattgtctagggtaatttcagaaaaacttcttggagtaagtgagatgaagcttgattatgttagaataccatattagggagctgtaagaatccatgaagaagaaactctaagtaaacaaacataaacatgaatgtgcatatttagctaagtaatttgaagcaatctgagtctacaaagcctttatttttgtttaattatctttgtgctatttgcttcctggtagtttatattctcccaaacttatcatgggcataattaaaagcaggagaattttaattaatgctgattgcattttattgtgagacagttgcaaaattcaaagcctttgcatcttataacaatgagctgcagggttttagctcttggtttttataaaatgacagttgaggtaagaatgataccaataattccctggtatcatgtctttcccttctttattgatagtaaatgtttccttttattttgtatctacaaagtcaattctcagatatctccctgccaaacgtgagaatctgtggcaaaattttacattattaaaatagaaacacaatggtgggttttattttatcctttgcttatttgtctgtttcctctttcactatatcaagacagaggtcttgtctccataccaaagttcagtttttatactcaaacacttaaatatcttttctattcttaacaaaagtttctgggaaatttttcttttaaggttatgatgtttcttttcagaagaaggagaaagagcagttgaatactggctggtgctttccattagtgttacaggtaatttcatgtgtaatgaggggaactctttgggcaagaaacagaatttggaagacaattctgcttccctttttgaattgtgtcattattttaaaagtgttcatcaatttctaaatcatatactgaaagtagaagacacatacctatgtgtcctgatctacatctttaacaaagaaacgtaagcattagttgagatgataaaatatgacatataagcttgctaaaatgacctttttcagctcctgtacccttctcttttggaggacacgacaggtgggtgttccctgagaaggtattcacaagcccatgagtgtgagttttactaaatgacattaaattattgaaaatgtaaaattgggaaaataatgaatttttatttgccaaataaaaattcggcgaatttttatttgccaacagagaccccccagaagctgtacttttcgatgcaatgttcctatagccttgctacggaaaagcctttatagagggtgatgggcaaagccacagattagggctggaaaaaaatccctccaggatacaaatttgaagattcatttttctcattactggtttacaacccagtgtgaagcttaaattggattgatcaaggtggaaaaatctttctgttatcaaaatggagcatattgccaaaaggaaaaggcaccaactgacctatagtgattgttctattgctgattttatcttcttcatgctagggcataatttatttcctctcactggaatggaagagaatctttgaaggagtctgagtaaaaggcagcaaaaggaaaattctattgataaaaatacaaaaattgaaagcagttgaaatctttaatataagaagtgtttcaagaacattaatatgaggtaaattatgtactaatcaattttaaagcattttaccttaacagtctgacccgcatgtacataacatacatgctgattttgcatggcttcttaagtattagaatgaaagtatcccaaaatacctaaatacctaaattaactaatctaggaggatctaagtaaggacaatacaaggaacacttatgtttgaacccagtttggaacataattttcaactctttctcattttctgcactgatgtgggaggtcactgatgttatattatacttgtcattcttgggctaaatattcaacctgcactgttatgtgtaccttgaggagtcctaggagcagtccttaggggacttccttttgccgaaggtgtttgctagtgaataaatgcagtcgtgcatcacttaatgacaaggaaacatcctgagaagtgcattcttaggcaattttgtctctgtgtgaacatcacagaatgtacctccacacatctagatggcatagccttctacacacttaggttatatggcatagcctattgttcctaggctacaaacctgtacagcatgttattgtaggcaattgtaacacaatagtaattatgtagatatctaaacatagaacaggtacagtaaaaatgtaggtggtataaaagatttaaaatggtacatctgtacagagcacttagcatgagtggagcatgcaggactggaagttgctctgggtgagtcagtgggtgagtggtgagtgaatgtgaaggcctgggcgattactatatactactgaagactttataaacactgtacacttaggctacacaactatgttaaaacaataagtaattatactatgatgttatgacagctgcaatgtcactaggcgacaggattttttcagctccattataatcttatggtaccatttttatatattcagtccactattgaccaatatgtcatatgcagcagatgactatatacaaaagcaagggaaaccacagttttttcttccttgatatcataatgtttaatacagataaattacctgtaacactgaacagaaaatctcacaggatatagttcaataatgttatggagctgaagactgatagcaaagtcaaatacagtatttataaaatgaattttttgtgtaattagttttaaaacctagcatcatactaaggccctcagatttcaacaaaaagaagaatgttgctttgagacgattaaaacagactgattaagaaagcccttcgtaacctggcacaaatctacctttccacttcaagacagccactttctgttatgcagctcaagtgtaggagtaccttccacctttataatcgctggagatttgtatatttagggcaataattttctgacagatgactaagggcaaggctttctagttctcagaaaagtgtcatttgggctcaaggtagtgtcattcaggctcaaggtagtgtcattccaaccttattcgctatagtatctaaaatcaaactctcacaccagttgtcttacattggattccatgagaaacaagctcgctggtggaaagtttcatacaagaaatttaatggcatatgtgcttgcatgaatgaacacctggaggaagtacaggaagtaggattaagcagaggggagaactgaactgctatgcaatcttaacaaagacatcaggcaattccatgggaacacttgagctgtgatatcccttcaaaattgttcactttgagggaaggagattgagattttatacccctgcattgaccagccattggatatggactcttacaggatagaggacatgacattgggtcagacatttttcttcagctgagagtaattccgtgaaagtatctgagcagtaaactatcaaccaccaatattctcaatagctgagagaatgagtacttggtcccgtatggggaatttgagtggcatgccactacacctactacactagccctacctttgcagtattctcattgtttctcctatccattaatgtaacagatatttattaggtacccaacctactggatgccagacatctgctgggtcttggcaacataaatttgaatataaagtgattctgcagtctaagcggaaaaaataccacctcttcaacacacacacacacacacacacacacacacacacacacacaaatagtggtgagtgctctaaaaatgatagacacaacatgctttggaaatgcaaaggagaaaatgtttgacttcctggggaaatttagtcagtcttcatgggagaaacatgagcctaacatatgtatattgcaatttccatgctttctacttgccctgattgtcctctccactatatttcacctatttagagcctcttctatatggctctgaccagttctaactctaccacaagctttatatctaccactatttaacccactttatgatctgagcaacctctgttgtgaactgcactagaattagcccctgatgccacatgccatttaccttctcctggaggtgtcatgtcactctatctaaatggcaaaaccagcaggacagggtcaacacaatacttaagtgaagattgtcatatcacagaatgtagaacccaaaaagtatttagagatgatcttgaccaagcatgtcaaatgcaggggagtggggcaggcaagaaaggaaattgtgattttcttgaggtatttcagcaaagaaagcaaagatttaagcttaggaccaagtccatggaccccacccattgccttacactatctctgccaatgaatgaaaccattcacaggtttagtcttaaaaaaagtttaaggaaactttgaagtatgtgttagaaagtagacttttttcaccaaagtaatagacaaactttatcaagctgagtgatcttatttataactcccatggactattctgttttactagacacatttaggggaagatcaaaagtatcttttattggagattcaacaaatggttggggcaaatccataataaattgtgtatgtccaattgagctactatggagaaactgaaaatattgaaaatgtttttgttctctctaatctttatagtctgtttccaaaaatgtccaggtgatataatgagacaaaattcactagtttagataaactactggcttgaatggctttgacaatttgtgtatctgcatgtgtgtgtgtttgtcgtctttatgcatagctatatttaaaccagccaaacctactgagcgaaacaatggtccctaaacctgactgacaatcagaattacccagaggtattttcaaatattcctgagtcccagtctctggagatgtgcactgaccatgtatgatatgtggtctaaacagctacctatgagaggctccccagataatcttcagtgcagccaggcttagaaattgtattataaagtatggggtgacagagcttggctgctctgtggtgctgctacagagggcagagtggtcctgccctctggcttatggcccctgactgctggtcagcttcaggcagccccactagtcacagagaggtctggagtgagggaaggaagggcaccgcagcagccatgccgtgaaaactgacaaacatattttacatgccatgtcaatagcatccctgaaggtgagttctaacaagtgcctcactctaatataatacttgctcctggctcaggcctcctcctcccctaatcatcgagtcacgtactctacacccttctctgctcatctctgataatcatgttggaaattgcctaaagagatactgcactttaataacctatgttatcttagcctcatttcctaacttaaaagaacaatagatcgttggaaataccatgaaggcaatttgagccataaaggcataaacaaaaataggtattaccataagagtaacaagtggtgtgtgtgagtgtttgtgtgtgtgtgtattcttaaaaatctagtccaagaaaatgaactttatttatttaaatttgcttgagtaaggccttatgcatttattatgatggcagatcaaaccctgctcaaaaatgtgatcatcatctctactgacttctatattctctttaattcagaattattaagttctcttaggcagtacatattaaaatttccttggagcaagagtctcttttctctaactgtgttaaataagatttcccacgtaaaatatttctatccattccatagtaacaaggctgattttaaatggatgaacgtagagaaattgagttccattccctaaacactccataattaccaaataacaggcactgattgctccaagacaaaaacctgatctcattagtacctgctgtttgggtagggagaagacaattacatgtgaagggtactaagcttttggaaatgctaattaattatacattatttattggaaatacaatgctctccttgtactgtagctaggaaaacagaggaagtgtaagaacttaaacagctgagacatgctgaattgtaatgaactatagtcattgtttcaaatctgggatcctttactggtttaaatacaatacctactctcaaagtctttttcttttatcagaacgggctatcaaggtctaagagtgtggaaaggaaattactcagttatttggcaggctttagccaaactaagctggtataggtggtttaattttcattttacaaaggtaaataatagataaataagtaacagtaaatagtaaataaacaatttcccagcccaaaccaaaaggctggtatcaataaagagataggagcttggcatgtgatggtttctgacaaagtaaattgctttgcatcattgttgtagaattgtacccatgctataaagtctttatacagtgctttcctgttagctggcattagtaacaaaagactaagagagcatgggatctctttacacacgaggcaaagaactggaagtaaggacttccatttctcacaagcctagcaatttgccttctctgcagtttatatgtcaagtgtgccagggaaaaaaatagccttacaggttaaaccgagcagtgttaccttgatttgctctcataatgtgatttttaataattatccatcaattcttccaaatatgtggagagcaaatgctagaatgtgaagaatacatatagttaacttgaaatttttatgtaatttattatttcacctaaatcatctggctggcagcatgacacatgggcaagaggcagatgacctgtgtgtctctctgacacctgctcccaagtccattattatcctcaattctctatcacatgaatatggtagaccagatagaagtctacaaacttaaaaatatatatattgtgtaaattttaaaacaaataagagtagacaatacagtataatgaagctctatgtatccaccattcagcttcaaccattggcaatacaatttctaataattaacattaagaaacattaagttaataagtactcacacatggcttatatgtaaattataaacagttatgtttacatttatgagctacaccaaggtattatgcacattttagaacacagatcataagtataaaattttaaaacatggaataaaatataatgaagttctgcacatgaaagttcatagcagatttatatgtgacagctgggagctagaaaccatctagatgtccttcatcaggtgaagagaaaagccaacaggtatattcacacaatgcaatactactcagtagtaaaaaaaaaaaatttaaaaaaactattgctatctattgatatatgcaataacattgtaagcagccagtctgaaaagacaacatattttgttgttccactttttttcacattctagaaaagataaaactattgttacataaaattaatcagtgtttgccagaggttataggtggggtaagaatataattataaaagattatctgagacagttctttgaggtgataaaactgtcttgagcctagttgtaatatggctatacaaatctacacacatattaaaattcatagaactgcaaaatacatgccaaaaaagtccattttattgtatgataatatacaaaaaaagaattaaaaaataatcgaatttaaatgctttctctttacaatcacatggttcattactcacattaatttaagaaccagtagactagactacctctaagttctctgttagtgatgatcataatctgaaataatgaggttaatataataaactagctaaaaaaattttgacgcttctcccattgagacaggaggagtcaacacccactctttgaatctgttagagctctgtgattgctttgacaaatggaacacagaggaaatgttactatgtctatttggggagccagatcttaagatactagaagcttctaccttgacatggaacacttactcttggaactcagccaccatgctgtgagaaaggccaagcaagcagctccgtagataatctcatgaagaaagaaactaagactcctggctgagctcccagccagcagctaggaccaacttgccagacatgtgagtgagtgaggctgttggaagtaactatctagctccagtcaaaccacccctgctgacgctgcaaggatggagatgagacatcccaccaagcactttctaaatttcagaatcatgatcaaaataaatcactggggttgtttcaagctgctaagtttggggaggtttattatatagtaatagtcaatttgtttgatagataatataataatagatatgtttgttatatagtaatagataatacagaacttaaaccattcttcaagaaaaagtaggcttcagagtcatgagttattgccttaatgcagaggttttttagtgtgtcaacctcagcaacctgaataagaatgatctgaagtgttgtgaaaaatgccaaacctaatgcatcagaatctcttgaattggggatccagaaactcagttttaacaagcttcccacatggttcttctgcatcctaatgtttgacgcccagcatttcagtcacactgaaaagattaattgaaagtaactggaccccaggatgatgtcacacgtcactaccacaaaaggtaaagaaacttagtgaagaaaaaaataccgtaagcaaaccaggtagagaggtccctgaagtgggcttgttctacaagacaaaatagagcccagcaaaggataaattctaaatgggcatgaaaagtaagagataataagatcaggtatattgccgaaaatagatatgacataaacagacatatcatattaataggatatttaagtcctgtgattttatgatttttgacaaattaaataagaatgataacatgaaggcaagattaacaaggctaaatttattttgttgtttgttaactagatagatagatgatagatagatagatagatagatagatctatttaaaaggaaagccatttaaaagctataaccacctttctttctttatgtaaatacaaacttttaaattcattagcaatattaatggctaaactagactcccataaggtattcttttcactttcatcccaaaatgaaagagagaaagagagaaaaggaaaaaaaataattgctacatctgcttcaaattaactttgaaataaagtgggaaatgaacaaattgaagacataaacattgtgttctagttactaaaaaagcaaaagcatgcatcaaaggagaagccagaatcctattgtagatatacatatttcaaactcaagaagctcaaagtagtctctgaaaggtagaaatgaaagggatctaagagtcatgatagaacatagaaaatttctaggtacattttcagaaacctatattttctggttttgttttcattttttaccagggctaaaagtcacctggctcaacattttctatagactttttgtagccacttatacagtatctatgattcatatttaattattactgttttctcccactaagaaacaaaaatccagacttttccctttatactcaatatgcagaagtgtactaggattaaacctgggttgtagtagtaaactcaagagttgatataaatggtaaatagcattaaccaagggactgaataataagataatacatgtaaacatacttaatatagactcctgcacattataagggcccaattaacataatttgccttaaatttttctaaagctaaattaattccttttgctttatgttatctctataaaagtagttatatttctgaaaacctgtcagaaattaagcataaaacttccactgagcagcagggccctctccactccaagcccaggcacttggacagctcaatcagcagcctgagctgcccaacccttcctgtgcagagactgtggtgcaacagggtcctctatgctccacacccaggattaggagtttacctccccaccacccatgcagagaacttccagcagaagagaattctcacctccatgcctagacacacgtctcagtgcttagtgccttctcactggacatcccttcagcactgatgcttgtgcctgccattggtggacctgcaagcaggcctgcctgtttcagtcccacccatcttggaccctccccacagggatgagcaagaagctcagactgccctatatactccacgtatcagcccattgcttgaggcagcagagagagtttctctcaataaataataatcaactatcagacccacctgcagttaactcttacccatatgcgccatcagttggcctgtagtttgagttacacagcccaatataagacctgctgacagaattgcgtagaagaaaagccaaagaccctaccccagcattctctacagtcacacctcctaggaaagtagggaaaggaaaatgaaaaaataaataaatacaagggaaaaatgaaaaaaattacaaaatttaaaagtgccagcatccccagatgagacggaaccagcacaagaattatggctccatgaaaaacctgaatgtggtgacaccaaagaatcacactagctctccagaaatcctccctaaacaaaatggaatttcagaaatgacatgaataattcaaagcatggattgtaaggatgctcaaatgagatccaagacaagtttgaaatcaaaacaaagaaacttctaaagcaatccagaaaataaggaacagatacatagctttaaaataatcaatcagagcttttggaattgacaaacttacttaagaaatttcaaaatacaaatgaaagttttatcaatagactagaccaagcagaagaaagaatttcagagcttgaagactagtctttcaaactaacccagttagctaaaaataaagaaaaaaaaattttaatgagcaagaccttcaagaaatatgggattatgtaaagtgaccaaatctatgaattattagaattcctgagagaggagaataacttggaaaacatatttgagacaataattcaataaaatttccttaactctgctagatggtcagacatccagatataagaaatccagagaacatctgtgagatgttatacaaagcaagtattgtcaaggcatatagtcaccagactgtccaaggccaacgataaagaacaatcttaaaggcagcttaaaaaaagaaatatcagaccatgtacaaagagaagcccatcaggctaaaagcagacatctcagtaaaaaatatacaaaccagaagagataagaggcctattttcagcattcttagagaaattccaaccaagaattttatatctcaccaaattaagcttcataagtgagagagaaataaaatcttttccataaaagccatcactaaggaaattcattatcactttaccagcattataggaaatccctaaggaagttctaaacagaaacaaaagaacaatacctggtatgaccaaacagacacacacacacacacacacacacacacacacacacacacacacactcttaagtacatatcccacagactctataaagttactaatatatagaaactacaaacagtgaacaacttcacaataggatcaaaacctcacatatcaatattaaccctgaatgtaaactgcctaacaccccacttaaaaggcacagagtggccaggtggataaaaagcgaaaacccatctgtctgctatattcaagagacccaactcacatgtaacaacactcataggctcaaagtaaaaggttggagtaaacattatcattataatgatattttatcattatgtaataaaacattattacataatgataaagaatccaattcaacaagatgacttaactatcctaaatatatatgcacccaatattggagcacccagatacataaaacaagtacttctagagctatgaaaagacttaggcagccaaacaatcatagtgagggacttcaacacctcaccatcagctttagacagatcactaaggcagataactggcaaagatattctggacttaaactcgacacttggccaattggacttaagagagatctacagaatatttcacccatcaaccacagaatatacattcttctcatctacacacaaaacatactccataatagaccacatgctcagccataaagcaagtctcaataaattcaacaaaacttaacatacgaaccattgttttggaccaaagtaaaataaaaatagcaatcaataccaagaaaatctctcaaaactacacaattacatggaaattaaacaacttgctcccgaataacttctgggtaaataataaaattaaggcagaaatgaaaaaattctttgaaataaatgaaaacagagacacagcataccaaaatctttgggatgcagcaaaagcagtgttaagaggaaagtttatagtgcaaaaaacctacatcaagaagttagaaagatctcaaattaatgatctaacatcacacaaatacaagaacaaaataaccccaaagctagcagaagaaaatgaataaccaaaatcagagcagaactgaacaaaattaagatgtacaaatccatacaaccgatcaacaaaaccaaaaattggctctttcaaacaataaacaagattgaccactagctagattaacaaagaaaaaaagaaagaaggtcctaacaggcaaaatcagaaatgacaaagttgacattacaaccaatcccacagaaatatacaaaagatcatcaaagactattatgaacacctttatgcacacaaactagaaaatccagaggaaatggatcaactcctggaaacaaaacaacctcccaagattgtatcaggaagaaattgtaatgctgaacagaccaatatccaattccaaaattgaatcagtagtagaaaacctaccaacaaaaaaaaaagccccacatggattcacagccaagtcctgcaagatgtacaaagaagagctgatactagttttaatgaaactattcaaaaaaattgagggggagggactcctccctaactcattttataaagccagcattaccctgataccaaaatatggcaaagacaccacgaaaaaagaaaactacaggtcaatattactgaagaacatagacagaaaaatactcaacaaaatgctagcaaactgaagctagaaatcacatcaaaaagttaattcaccatgaccaagtgggctttatttctgggatgcaaggttggttcaacatatgcaagtcagtaaatgtgatttaccacataacagaatgaaaaacaaaaatcaaatgatgatctcaatagatgtagaacaggcttttggtaaaatccaaaatggctttatgataaaaacactcaacgaattaggcttagaaagaacatacctcaaaatagtaagaacggtctaagagaaacccacagccaacatcatactgaatgggcagaagttggaagcatgccccttaagaacaggaagaaaacaaaaatgcccactctcactactattattctacctggcactggaagtgctagccagagcaatcagtcaagagaaataaataaaatgtatccaaataggaaaagaagaattcaaactacttctctttgctgacaatatgattctatacctagaaaactttaaagactctacccaaagatgcctagaactgacaaatgagttcagtaaagttttaggatacaaaatcaatgtatgaaaaccagtagcacttctatacaccaataacattcaaactgagagccaaaacaaaaatgcaattccatttataataactacacacacacacaccacaaatacctaggaatacatctaaccaaggaagtgaaaagatctctacaaagagaactataaaacactgttgaaagaaaacataagtgacacaaacaaatggaaaaacattccatgctcatggattggaagaatcaacataaataaaaagaccatactgcccaaagcaatcaatagattcaatgttattcctatcaaattaccaatgtcatttttcacagaaccagaaaaaactactctaaaatagtttttagagtagttggctttaatagccaaggcaatcgtaagcaaaaagaacaaagcctgaagcatcacattacctgactttaaaatatacaataaggcagcagtaatcaaaacagcatggtactggtacaaaaacagacagaccaatggaactgaatagagaacccaaaactaaagccacacaagtgcaaccatctgactttgacaaagcttacaaaaataagcaatgggaaaaggactcccctattcaataaatgctgctggaatcactggctagccacattcagaagaataaatttgaatacctacctttcacatatacaatactgaaaatggattaaatatcttatatgtaagaccttaacctataaaaatcttagaagaaaacctaggaaataccattctggacattggctttagcaaataatttatgactaagtcctcgaaagcaattgcaacaaaaacaaaacttgacaaatgggacctaattaaactaaagagcttccgcacaacaaaagatactattgacggagtaaacagacaacctacagagcgggagaaaatattagcaaactatgcattcaacaaagatctaatatccagaatctatagggaacttcttcaattcaacaagcaaaaagcaattcaacaagcaaaaaaccagtaatcccattaaaaagtgggcaaaggatttgaacagacactttttgaaagaagacttaaaagcggccaacaaacatatgaaaaattgctcaatatcattattcatcagagaaatgcaaaccaaaaccacaatgagatacatcctaccctagtcgcaatggctattattaggaagtcaaaaaacaacagatgctggtgaggctgtgaagaaaaagaaacacttacaccctgctggtgggaatataaattagattaccttccatagaaagtggcttggaaatttctcacagaacttagaactaccatttgacccagcaatcccattactgggtatatacccaaaggaaaataaatcattctaccaaaaaaacacatgcactggtatgttcattgcagtgctattcacaatggcaaagacatggagtcaacctaggcacccatcagtggtggattggataaagacaatgtggtacatatacaccatgaaatactatgcaggcattaaaaaaaagcacaatcatgatctttggagcaacacagatgcagctggaggccattatcctaagcgaattaagactggaatagaaaaccaaatattgcatgttctcacaagtggaagctaaacattgggtacacatggacataaatatggaaacagtaaacactaacggaataccagagaggtgatcaagagctgaaaatctacctatttattgctctcctcactacctgggttatgagatcattcataccccaaacctcagcatcatgaaatatactcattcaacaaacctgcacatataccgcctcaatcttaataaaagttgaaattatttttaaaaaaatttccactcaaaccccacatctaacctaaatgttttagtataacatactaaaacatacccttttattttagattttgtatggtgtcctgtgacaataaaatgtatagggaagatttcataaatgtactaaatataatagtacatttcatctgcaaatttcagaacttttaaaatttcataatgtcagtctgaccttttctggttgtcttcaagattcccatttaacaaaaccagaagacaaagcagtagctcctcttgtcaagtaggtagaattacatggtttttctgatagcaatgacagtagataacaaagttgccagcatgagtcagcctggctggagctgagtggagggcttctcactgcatcatcctgttatgctttggctccaatgctctcaatatcttcttgaagtccatgctggagatgactttggcaagaacaagtgtccagagatgattaagaaacaggacttacaagaacttaagcagcattaggcctagtaaagagttaaagatgcaaatatctgtatgaagagttgagcagagtaaaacctaaaccttttattaaacaaaaaaaatgagttttcctggaaagttgaagtgtgataggtccatttattattaaagggagtaaatgcagtttctgccaagttcactcacagaggagactagactcagtgtcctgcctctgtttgacattctcacaagattccactatttgttttctaagaaaacattacctagtagtagtcagcttttccagtgttagaaccttgtaaatgacattgtgtataacgcactggcatttatttttaatgaatgttttcttctttctgtcttctcaaacttgcaatttatttaagatgtttgaagttgattgattctatgtatcttcatagatagggaaggtaacactctctccatttcagttaaagcattccttcatgattcttttaaatcagtgatgaatgatttaataatgatcacaactgctgaaccatagtttggaaattcagtaacatagaggcggaggaaacgcccttatagttggtatcgggaaacacaaagaattattttcctacatctgaaaattccagtaaggttttagagttatcttaaagtaatttttaattgttctgtgaaaactttttattcttcacatgaaaacaatgtgtaaggcattgtattagagtgcccacacatcgtgccagttctgatgaccacagcatggtatttctatttcaactctgtagctgaatatttcccatttcccatctgtctgctgatttgtaacagaataattattttatagctagtagatttgacaaaatgagatgcaatgtcaaataattttcacacttttttctaaatgcaatatgctttggggttactgaggaacaaaagattctgaattaattcactttgtcgctgatgacaaaaacaactagaatttgcaaaggtgatttatcttaattaaacatgagttaacatatctccccaccaaaacaaatcctatcataggaagctgcaatatgcttgggggcttgatatccagagagacttcaaatttacttgaaattgcattagttgtatagtctgggtttattatgtgcaaggtacgtcctaatgctgataagaatgataaaagtaaggataaactcttttaatgcgtaaaaacttaggaaaacaaaatgtatagagaggaagtacttaagtcctaggacgtagaagtgtgcaaaggtgtgtgtgtgtgtgtatctcactctgaacaataccgctctgtgtgtgtgtgtgtgtgtgtgtatataaaatgagcatatcatgaaatatactcaagcatattgcagcttcctatgataggattccttttggtggggagatatattaactcatgtttaattaagagaaatcatgtttgcaaattctaattattttcatcatcagaggcaaagtgaattttatatatatacatatatatatacacacacacatatatacacacatacacacatatatattgttcaaagtgcttcactgaacaccagaggagttaggtgggacatttagaagagagatttgtacatttggtgaaactttaattaaaaatggaagatgcaaacaagtaaaattgtgtagctagaataactctcaaattatcttataattgtcttaattgatgtgtaaatgttattctgctcccatgtatgtctacataagtttctgccagagaaaattcatcttgcagatcaagcagatagggatattggttgatgagggacttattgactccatatacggaagccttttgtatttgtgagacacaattattaggcatcagcactaaaaacaccatttgcatatgtatcttaacttccacaaaataatcgaaaattatatccaaaagaataaactccttagcatttcagaagctgatttccaattatcccagtaaaatgtaaatgtgccagacaatatttttgtttctgggggatcaccagaaaaacttggactcttctaatggaaaataaaagagtgattttttattaacttttagctttggataactcgggtagaaattgtaatacacaccagcgtcatctcccatcttgctcctgagtacaaggattgtaggcatttaactccattccacagctctccagggtgtagacatttcagacataattttacctcccttcgtacacacacccaatcctatctcacacagctatctctctaataggcagaaatcagacagtgatgcagtttctctgttatgttgtttttgactctactactttcctccttctaaagacataacaacaagaattccttgtctattatcaactttttcttctttatttacgcacgcttaattttcttttttcaaccaacttaaaatctgctaagcctgacagactattctatttaaagattttagaggatttgcctacattaaaaaaaaaaaaacaaaaacgactttcacaccaagacagaataaaatagaaatcacctttgtctctatcaaacaaatttggatttcctaaaaagtctcttaaaaattggtagaaaaaaaacaaaacatacccgtatttgaagcggcattattttagctttttgaaatgcttagtaaaaggaagtaaatctgttgtagagacctcatgatttggtatgtatcaaataaatgaaatcagaagttggtttcaaactagaagatcaaataactttttttcttttaatttatttgtttatttttagaaatggtctccctctgtcacccaggctggagtgcagtagtgtgatcacagttcactgtaactgtgggctcctgggctcaataatcctcctggagcccaactcctgggctcaagcaatcctcctgcctcagcctcctgagtagctggtactacaggtgtgtgccaccattcctggaaaattttttacaaaaattttgttagggtctcactatgttgccctggctggtctcgaactcaggcctcaagcaatattccctccttggcctcccaaagtgctgaaattgcaggcatgaaccaccacacccagcctgcctaagacatttataaaatgccttccccacattcaagaatcatacattagttctagaattttctctctagattgtaaacaagattgaggatagaagtaaattttcttttcatgcttatgtattcatatccacatacatcccctccaaagcactgctcttagtaggcattcaataaatatttttgaatgaataaatggcttttgtaaatacgagctcagccttactgttatcactaggagaaacaaatatatttctggcatacatcttccttaacctacattatcctcctactgctaattccacatgaaaaatagacatctcaaaaggatattgacttatttagtgacctggtcatgtacttagtgtttacaatgcatataccattgttcaacatagtctgctcagttccactatagacatatccatcaagctttctaaaaaaaaaaaaattaacagtaaaacatattacctttccttttgagcttgatttatttaaacctggagggtcacaaaaaaaaaaaaaacaatcagagagaaattgagtttccctttcttcttgttcctgtccttttacactgctctctacatttttgtgctaaaacttctttttatgaagagacttccagaagtccagattgcttgagaggctcagattgataatatctatgctgtattaatgctgattgaccttccgggataaaagggacttcacaaataaatattataattgcaagcaaagcaaatattaccagattgatttctccaaccattttaatagtattacatacctcttcagttcccagtttctatatttaaatgttggcaactcagcccacataaaggaaaaatataactatggcaaaggaaggggaaaatgtctctattgaatatatggcctactgagaacatctgagaaagagtcatcaaaccatgcctctgttgttcatgcacaggtatgaacagcagtgcatcatcatggcacctctggaacagctaggagtatgcttgctttttgcacacttttgcattttccccagggactttcaaattgaagaactcagctagagggttcacacatctactgcagccaggtctttgtggtaggtagcataatggacctccaaagatgggcttgtcctaatccccagacctgttaatatgttatcttacatagaacaaggtactttgcagctgtgattataattaaggaccctagaatgcggaaattttcctagattattcccaggagttcaatataatatttttaaattgataaattataataatcataattgtattacatttatggagtacaatgtgatgttttcatatatgtatataatacggagttattaaatcaaattaattaacatatatatcccttcccttgcttgacattttttgtgatgacatctttgaaatttactctcttattttgaaatacacagtacattattattggctatggtcaccctgctgtgcaacagatctctaaacctcctgtctagctaaaactgtgtatcctttaaacagtaactccacattctctcactcctccccacccaagccccccatccctggctctggtaaccaccattccattctccacttacatggatgaatcttttttagatttcacatataaatgagatcaagtagtatttatctttctgtgcatggcttatttcacttagcataacatctgctagattcatccatcttgtcccaaatgacagaatttcatctttttaaagaataagtaatatttcattttgtttactctattttctttatccaactgttgatggacaagttgattccatatcttgactactgcggataatgctgcaatgaacctgggagtgcagatatctctttggcatacttaataatttcccttgtaatacccagtagtgggattgctagatcatatgggagttctatttttagtttttggaggaaattccatactggtttccataatggctgaaccatttacattaccaccaatagtgtacaagcattcccttttctctacatcctctccagtggttgttatctttcatctttttggtaaaagccattctattgggtataaatagatatcttgttgtggtttttaaattgtgttttcctaatgattagttcatttgttaatgaaccttttggccgtttggatgagttcttttgagaagtgtttgttcaggtcctttgcccacttttaaatcggtttatttgtttgcttactattgagttatttcagttccttgtatattttgtacattaaacccttactagatatatgagctatctgaaaagaaagttaagaaaataatcccatttacaatagcaacagaaaaaaatttaaaacttagatgtaaatttaaatcagaaggtaaaagacttatatactgaagactataaaacactgatgaatgaaattgaagaaaacacaaataaattgaaaaatatcccatctctatggactgaaataattaatattattaaaattcccatactacaaaaaataatctacagattcaatgcaatccctataaaaatttcaaggtcatttttcaaaaatggaaaaatcaatcctaaaattctgtggaaccacaatacaccccagataaccaaagtaatcttgagcaaaaagaacaaagctacaggcatcatactacctgatttcaaaatgttttataaaagtgattataattaaaacagcataatactggcataaaaacagacacatcgacctatggaacaggacagaaagctcagtaataaactcatgccttcatggtcaattgattttttacaaaactgccaagaacccataatggaggaaaaacattctattcaataaattgttcaaggaaaaccagttatccacattcagaaaaaaatgaaattagacccttaccttacactatgctccaaaataaactcaaaatgattaaagacttaaagctgtaaaactactagaagaaaacataggaaaagctccatgacattggtttggacaaggatttttttagatgtaaccccaaaatctcaagtaacaaaagcacaaatagacaaatgggattgcatcaaattaagaagcttctgcacagcaaaagaaacgatgaacaaagtgaagagacaacccatgcaatgagaaaaatatttgcaaaccatgggtctttacaagtggaagagagaggcagtagaatgagtgggtcatacagaggagatagaattcagccagttgttggttgttgctggctttgtagtttaaaggggacccagatgcaaggaacacagattaagctggaaaaggcaaggaaatggattgtcccctagagactccagaaaaacagttccctgctaacgtcttttttctttttttaattaattaattaattaattaattaattttttatttatttattttttttgagacagagtctcattcggtcacctaggctagaatgctgtggtgctatgtcaactcactgcaacctccacctcactcattcaagtgattctcctgcctcagcttcccaagtagctgggactacaggcacatgccaccacacctagctgatttttatatttttagtaaagacggtttcaccatgttggccaggctggtctcaaacccctgacctcaagtgatcagcccacctcggcctcccaaagtgctagaattacaggcattagtcaccatggccggcccctgctgacatcttgattttagcccagggagattcatgttagacttttgacttctagaaatgtaaggtaataaatttgtgctttttaaatgactaagtttgtgatgatttgccacagcaacaatagggaactaatagagtgctttttcacgcatttttttctcatctatgataagagagctttctgtgtctccttctgaaaggaaagtctgctgtaagagggagtgctgttcactgcaacctcactcctctcctttgctggtgtatgtaccaatgtataacctttctgcacaaatgaaatgccatgcaagaagtaaaaagtttgagaactagcccatttgtcagtaggagtccaaaactttatactaagaatcctaaatccgataactaagaagtgacttgaggcactcgcaacttcattattaaaggttatttgcatgacaaattaatactgtagtaacagtagttgccaatgcaaaagctaaaccaagaacttaaatgccacaaacatgcagattattggcccggttgatggaacagggcaactttggccttaaatattttttggcaacttaacatatttgcatttttgcctcaagctatttaaatattttaggattccattatttacagagagcataatgggggaactctccagagttactgaaggttaaaccggataaaaagtgaaagtatccacagaataaaataactccctagatatcttgtgtacacatgtccaaccaaaaaggacaatttatttccacatatggtagggatttcagattccttcagaaaatttcagattaactccttatatttaggagtcttaattaagctgtaggttatcacttacaacaaaatgtgaagtcagagtaaatgaaaaatgttactttttacccaagaatagagtgggtcctcactccattgcttcacaagataaaattgtaattgtcttttacttcaacgttaacagatattgatagttgagccttaatgggaacactttgttttgttgttctatattagttgctttgatacaaaatgctgtacattagaatttaatgtgatctgcctgaagtccagatgaaaaaagattaaggcaaaagacaagaatgagaaagaattcctggtcaaaggagattgtttcattttggtggctgtccccatttgggctcccataaatgcactgccaggactatcgggggcagaaatattgagcctgggcagtcgactaaccacagcatcaccaacacgaatcatactcccattacccaacaaggaaatactgtctacgaaggggcccctagtgctctgcaccctcccgttcacttaccttcctgcttcacatttgaaaggcagtttagatgaaataatgcccgtttttcctaccaagtatattgtatgcaaccgtaaatcatcaaagaaccactgccccgacctagaacatatttggacatcactagaaataaaaaaaaggaatattagatcatgtgttggatttttttagggttaatataaaggcagatgtccaaagttagggatgctttcaatgctttcctatttccagttctcttgctcctacgttggctctgtgttttataaatcttctttttcataatgtagattcattgacctgctggatagtagattatatatatatatatatatatatatatagtacctaatagagttggctccttgccttgtatttatcaaagattcttcccccaactctcatcagtccttccccaaacaagaagtttaacaaaagagactagggacttctttagctcacttgtcgccaccatcccacaggacctgaatatgagtcctgtccaggagcagtggtgaactggaacagagcaaatatagtacccacagtgaatgacgaaagaggattggatcaggattgaaaactctaaataactgatgtagcttacacatttattactttggcttatcacagttatcccagaagatgtgaaataaaatcagagaaaagagaattttaaacagacattcacataataggccatacagacatgcagactgctgaccaggcacaaaattctggcaggcaggactgggagctagaggaaactggcattacttaagcaaggactgaacagtgtattcggaaaagaaaaaaatgagtggcctagggaaaagacaggctttgttctgaccaatcctttttgttcaccacacacccaaactgctagcagattcaaagtaattttactaaatacaacattcaccctgctttctgtattctattgatttacttaataaaaacaaacctgctttgtgattctagctacacagaactaaccagagaccccagtctttttagaagatatagagtgaattcagaatgtcaagtttctaaaacttaattgctatccataagatagaaaaatctcaattagaacttgaattcttaaaaattcatctatgatcacacagctatcagagaggaataaagataaaaaaaacactaacataacatgtagagggcaggaaagaaagcccatgtgttttcagtccagtaaatgatgaatgtgcaagaaagaggcatgaactaaaagagctttgacagaagaattttcttttttcaaagttaaaagaaagtttagttcccttttaaataacagaatcttctttttccagttgattttttttatttccaacttttattttaagttcaggggtacatgtgcaggatgtgcaggtttgttacataggtaaacatgtgccatgatggtttactgtacagattattccatcacctaggtattaggcacagcatctattagctattcttcctgatgttctccttcctctcatcccccaccctccaacaggtcccatgtatgttattctgcccctcgtgaccatgtgttctcatcattcagctcccacttataagtcagaacatgtggtatttggttttcagttcctgcattagtttgctaaggataatgacctccagctccatccatgttcatgcaaagaacatgatctcattcctttttaaggctgcatattattctgtggtatacatttaccacatcttccttatttagtctatccttggtaggcattgtattaatctgttctcatgctgcgaataaagacccaaggctgggtaattgataaaggaaagaggtttaattgactcacagttccacatggctggggaggcctcacaatcatggtcgaaggtgaatgaggagcaaagtcatgtcttacacggtggcaggcaagagagcttgtgcagggtaactcccatatataaaaccataaaatcttgtgagacttattcactaccatgaaaacagtatggcagaaactgcccccgtgattcaattatctccatctgtccctgcccttgacatgtggggattattacaattcaaggtgagatttgggtggcaacacaaccaaaccatctcaggcatttaggttgattccatgtctttgccgttgtgaatggtgctgcaatgaacacacacacgcatgtatctttataacagaataatttatattcctttaggtatatatccagtaatgggattgctgggccaaatggtatttctgctgctaggtctttgtaaaatcaccacactgtcttccacaatggttgaactaatttacactcccactaaccgtgtaaaagtgttcctttttcttcacaacctcaccagcatttgttttttgactttttagtaatagcctttatgactgacattagatggtatttcattgcggttttgatttgcatttctctaatcatcagtgatagtgagctctttttcatatgattgttggccacatgtatgtcttcctttgagaagtctctgttcatgttctttgcccactttttaatggagttgtttggttttctcttgtaaatttaagttctttatagatgctggatatcagccctttgtcagatggttagagtgcaaaaaactgtctcccactctgtaggttgtatttgctctgttgatagtatgttttgctgtgcagaagctgtttagtttaattagaccccatcggtcaatttttgctttttttgcaattgcttctagcatcttggtcatgaaactttgcccgtgcttatgtcctgaatggcattgcttaggttttcttctaggtttttatagttttggggattacatttaagtctttaatgcatcttgagttgacttttgtatacaatgtaaggaaaggatccagttttaattttctgcatatggctaaccagttctcccagcatcatttatcatatagggaatcttttccccattgcttgtttttgtcaggtttgtcaaagatcagatagttgtaggtgtgtggccttatttctgggttctctattgtattccattggtctatgtgtctgctcttgtactagtacaatgccattttggttactgtagcctttagtatagtttgaagttgggtaacattatgcctccagctttgttctttctgcttaggattgccttggttattttggctcttttctggttttatgaattttaaaatagtttttctgattctgtgaagtatgtcaatggtagtttaatgggagtagcactgaatctataaattgctttgggcagtatggccgttttcacgatattgattctatccacgagcatggaatgtttttccatttatttgtgtcatctctgatttcttttcaatggtttgtagttcttcttaaaaatatccttcatttctcttgttagctgttttcctaggtattttatcctttttgtggcaattgtgaatgggagttcatttgtgatttggctctcagcttgactgttgttggtgtataggaatgctagcaatttttgctcattgattttgtatcctatgactttgctgaagttgcttatcagcttaagaagcttcttggccgagacgatgggatattctagacataggatcatgtcatctgcaaacagatagtttgacttcctctcttcctatttgaatcctctttatttctttctcttgcctgattgcctgggccagaacttccaatactatgttgaatagtagtggtgagagagggcaaacttgacttgagccagttttcaaggggaatgcttccaggttttgcccattcactatggactgtgggtttgtcatgtgtggctcttattattttgaggtatgtaccttcaatatctagtttattgagagttttcaatatgaagggatgttaaattttatcaaaggccttttctgcatctattgagataatcatgtggtttttgtccttagatctgtttatgtgatgaattacatttattgttttgtgtatgttgaaccagcttgcatctcagagatgaagccaacttgattgtggtggataagctttttgatgtgctactggattcagtttgccagtgttttgttgaggatttttgcatcgatgttcatccaggatatggcctaaagttttccttttttgtcatatctctgccaggttttggtatcaggataatggtggcctcatagaataagttagggaggagtccctccttttcaattttttggaatagtttcagtcggagtggtaccagctattttctgtacctctgctagaattcagatgtgaattcatctggtcctgggctttttttttttttttttttggttggtaggttatttattactgtctcaatttcagaactctctattggtctattcagggattcaatttcttcctgattcagtcttgggagggcatatgtgccaggaatgtatccatttcctctttttttatggaaattttttttattattatacttcaagttttagggtacatgtgcacaatgtgcaagtttgttacatatgtatacatgtgccatgttggtgtgctgcacccattaactcatcatttaacattaggtatatctcctaatgctatccctctcccctcccccccacccaccccacaacaggtccaagtgtgtgatattccccttcctgtgtccatgtgttctcattgttcacttcccacctatgagtgagaacatgcggtgtttggttttttgtccttccgatagtttgctgagagtgatggtttccagcttcatgcatgtccctacaaagaacatgaactcgtcattttttatggctgcatagtattccatggtgtatatgtgccacattttcttaatccagtctatcattggtggacatttggcttggttccaagtctttgctattgtgaatagtgctgcagtaaacatatgtgtgcatgtgtctttatagcagcatgatttataatcctttgggtatatacccagtaatgcgatagctgggtgaaatggtttttctagttctagatccctgaggaatcaccacactgacttccaaaatggttgaactagtttacagtctcaccaacagagtaaaagtgatcctatttctccagatcctctccagcacctgttgtttcctgactttttaatgatcgccattctaactggtgtgagatgctatctcattgtggttttgatttgcatttctctgatggccagtgatgatgagcattttttcatgtgtcttttggctgcataaatgtcttattttgagaagtgtctgttcaggtccttcacccactttttgatggggttgtttgtttttttcttgtaaatttgttggagttcattgtagattctgcatattagccctttgtcagatgagtagattgcaaaaattttctcccattctgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgactaggttttcttctagggtttttatggttttaggtctaacatttaagtctataatccatcttgaattaatttttgtataaggtgtaaggaagggatccagtttcagctttccacatatggctagccagttttcccagcaccatttattaaatagggaatcctttccccattgcttgtttttctcaggtttgtcaaagatcaaatggttgtagatatgcagcgttatttctgaggtgtctgttctgttccattggtctatatctctgttttggtaccagtatcatgctgttttggttactgtagccttgtagtatagtttgaagtcaggtagcgtgatgcctccagctttgttcttttggcttagcattgtcttggctatgtggggtcttttttggttccatatgaactttaaagtagttttttccaattctgtgaagaaagtcattggtagcttgatggggatggcattgaatctctaaattaccttgggcagtatggccattttcacaatattgattcttcctacccatgagcatggaatgttcttccatttgcttgtatcctcttttatttccttgagcagtggtttgtagttctccttgaagaggtccttcacatcccttgtaagttggattgctaggtattttattctctttgaagcaattgtgaatgggagttccctcatgatttggctctctgtttgtctgttattggtgtataagaatgcttctgatttttgcacattgattttgtatcctgagactttgctgaagttgcctatcagcttaaggagattttgggctgaggcgatggggttttctagatatacaatcatgtcctctgcaaacagggacaatttgacttcctcttttcctaattgaataccctttatttccttctcctgcctgattgccctggccagaacttccaacactatttttaataggagtggtgagagaggacatccccgtcttgtgccggttttcaaagggaatgcttccaggttttgcccattcaatatgatattggctgtgggtttgtcatagatagctcttattattttgaggtacatcccatcaatacctaatttattgagagtttttagcatgaagcattgttgaattttgtcaaaggccttttctgcatctattgagataattatatggttttttcattggttctgtttatatgctggattacatttattgttttgcatatgttgaaccagccttgcatcccaaggatgaagcccacttgatcatggtggataagctttttgatgtgctgctggattcggtttgccagtattttattgaggatttttgcagcaatgttcatcagggatattggtctaaaattctctttttttgttgtgtttctgccaggctttggtatcaggatgatgctggcctcataaaatgagttagggaggattccctctttttctattgataggaatagtttagaaggaaaggtaccagctcctccttctacctctggtagaattcagctgtgaatccatctggtcctggactttttttggttggtaagctattaattgttgcctcaatttcagagcctgttattggtctattcggagattcatctttttcctgatttagtcttgggagggtgtatgtgttgaggaatttatccatttcttctagattttctagtttatttgtgtagaggtgtttatagtatctctgatggtagtttatatttctgtgggatcggtggtgatatcccctttatcgttttttattgcatctatttgattcttctctcttttcttctttattagtcttgctagcgggctatcaattttgttgatcttttcaaaaaccagctcctggattcattgattttttgaagggttttttctgtctctatttccttcagttctgctctgatcttagttatttcttgtcttctgctagcttttgaatgtgtttgctcttgcttctctagttcttttaattgtgatattagggtatcaattttagatctttcctgctttctcttgtgggcattcagtgctataaatttccctctacacactgctttgaatgtgtcccaaagattctggtatgttgtgtctttgttctcgttggtttcaaagaacatctttatttctgccttcatttcgttatgtacccagtagtcattcaggagcaggttgttctgtttccatgtagttgagcagttctgagtgagtttcttaatcctgagttctagtttgattgctctgtggtctgagagacagtttgttatcatttctgttcttttacatttgctgacgagtgcttaacttccaagtatgtggtcagttttggaataagtgtggtgtggtgctgagaagaatgtatattctgttgatttgaggtggagagttctgtagatgcctattaggtccacttggtgcagagctgagttcaattcctgaatatccttgttaacattctgtcttgttgacctgtctaatgttgacagtggggtaacaaagtctcccattattattgtatgggagtttaagtctctttctaggtctctaaggacttgctttatgaatctgggtgctcctgtatttggtgcatatatatgtagaatagttagctctgcttgttgaattgatccctttagcattatgtaatggccttctttgtctcttttgatctttgttggtttaaagtctgttttatcagagagtaagattgcaacccctgccttcttttgttttccatttgcttggtagatcttcctccatccctttattttgagcctatgtgtgtctctgcacgtgagatgggtttcttgaatacagcacactgatggatcttgactctttatccaatttgccagtctgtgtcttttaattggagcacttagcccatttagaatgtatccatttcttctagattttctaacttatgtgtacaaaggtgtttacagtattctctgatggttgtttgtatgtctgtggggtcagtggtaatgttccccttatcatttctaattgtgtttatttgaatcttctctatgtttagtttattagtctagctatcagtctatctattttattaattttctccaggaaaagcagctcctggatttgttgatttttgaagggtttttcatgtctctgtctccttcaattcagctctgatgttggttatttttgctagctttcaggtttgtgtgctcttggttctctggttcttttaactgtgatgttaagttgttaactcgagatctttctagctttttgatgtgggtatttagtgctgtagatttctctcttgacactgctttatctacatcccacacatgctggtacattgtatctttgctctcattagtttcaaagaacttcttgatttctgcaatgatttcattatttacccaaaagtcatccagaagcaggttgttcagtttcagtgtagtcatatggttttctgtgaatttcttaattttgagttctaatttgattgtgctgtggtccaagagatgatttgttaggatttcagctcttttgcatttgctgaggagtgttttacttctgattatgtgatcaattttagagtaagttccatgtggtaatgagaagaatatgtattctgttgttttggggtggagagttctgtagttatctatcaggtcaacttgatccagagctgagttcaggccctgaatatctttgttaatgttctgcctcaatgatctgcctaatattgtcagtgaggtgttaaaatctctcactattattgtgtgggagtctaagtctctgttaaagtctgtaagaacttgctttatgcatctgggtgcccctgtattgggtgcatatatatttaagatagttggcacttattgaattgaaacctttgccattatgtaatgcccttttctgtccttttgatctttgttagtttaaactctatcttatcagaaacttggattgcaactcctgctttcttctgttctccatttgctcagtaaattttcctctatcccttcattttgagcctctgtgtgtctttgcatgttagatagctctcttgaagacagcgtacagatggatcttgattctttatctggtttgccattctgtgtcttttaattggggcatgtagctcatttacatttaaggttagtattgttaggtgtggatttgatcctgtcatcatgatgctagctgattatttttgcagactagtttatgtggttacttcatagtgtcactagtctgtgcacttccatatgtttttgtaatggctggtaacgatttttcctttccatatttagtgcttccttcatacgctcctgtaaggcagaggtttaacatcccactgacattattaggcagttcattgagacagcatttgcctgcctaagcatttgcctgtctgaaaaggatcttatttctccttcacttataatgcttagtttgtctggatatgaaattctgggctggaaattcttttcttttttttatttttattttttgtttttttgtttgtttgtttgtgttcagtacaaacttagggctctttaggcaataaagtaaggaacagcaaagtgggaggactacaccttcaccgtggcaacagaaagcctcaaaaatgtaaagtccctcaacttctattgggcagactcttcctagctcagaagaaacacattttaactggctgggaacaaggcctgccagcctggccacagtgtggaagggcagctggtcacacagcctctggtcaggcctggaagtgctcagagagaacttccagcagctcctgcttcttcagcccatatgcctctttcagcatgggcacagtgaaattgcccagcatgcccttgctgatattggccttcagctcctcttctgaatacttcatcttgggtcttttgcttccaaaatcttcattattttgttttctcttggtaaatttcccttcaggattgtaatctggtgggtaaacaagctccttaaactcaaccaccagggagtccaatcttttattcattgcttcaaccttgggcaatgtcaggtccactgcttgttcagtctccatcaaatccaaggccaaggcctccaggttcctgaagtgctgctgcagcccagggttctcaaagctgtcacttctgcatgtgaagcggagcttctgaacgatagccttcatcttgtccacctgctctggagttgccatgactttcagtaaagggcatcttccttttatcatcagcaaagagtaaaaagacaagctggaatcctggaggagtcaccagaaatttctggtcatccaactcctcttcctgtggcaccaaagccacaaaataaagagagatgttcctgcggggtgtgtatctgcgtgatgctacaacctccttgtccagacactttatgtgcagagcactaaacagggttgagctcccaatcaccagcaactcctcagggcacatgaacagggagggcctcagatgatggtgcttcttcagcattaccaagggcttacaccccatgagcatcaaacctggatcatcaaactgttttaactcttctgtttcccctttctccattataatctgagactcccatagatctcagacctcttggtatcactaggcagaagcaaacttcctgtatttgtattaaatgtctgggtcttggttttcactggttcatttgtttcccaatagagctttattggagaaggcttgagagccctctggaccagattataaatgcccagagatcactatatctttgatgagcttcagctttaacctgcttagtgcttgcttcctggtctccttggagtgaaccttctagtttgctggattcctcaaagtgaaccctgaggtcctcatcctctgctatgctggtgatatctctatagaataaggatatgtcaaagcccccaggtttcttcaggtgcttcaagtcaaggaagatacctgtatctcagagatcaccagctttggtcctggctcagctggcttaggcactgtcattgccatggggttgtcttcattggtgaacagcatgatcttgttatgactcatcatgaactggacatcactaaagaggttggcacagatacacagcacttcactgagtgagtcatcagatctgtggcccatcaggtcttggaaacgtttttgttcctgctgccccttaaactggtcaagctctagaatttattttgcacctggcttatccaactcctgtaagatgtaaatatttcactgaatctttgtctttctctgcactatagagcatcactgccaagagatctcaaacactgtttatgatcttactgatgtacacactttggatacactggatgctcatgtcaaagggagtcaactcatctttactctgagattcaaacatagccctggaggcatcaacaaaaaaaaaacaaactatctcttcctgaatacttatagtctccacttgcttcaaggttctcttcttgttcttctttgcttcttcatcggcctcagttttgtaatacgactcccacctttacatgttggctacttctcactttggtgtagggaagtgaccaacttggaccagaaattctttcctttaagaatgttgaatatagggccccaatctcttctggctgtagagtttcttctgagaggatcactgttattctcatgggcttccctttgtaggtgaccttgcctttctcttaacattatttgctgcccttaacattatttgtttcatttcgaccttagagatctgatgattatgtatcttggggataatcttttcatggagtatcttactggagttctctgcatttcctgaatttgaatgttggcctgtgttgccaggttgaggaagttctcctggatgatatcctgaagtatgttttccaaattggttccattctccctgtctctttcacgtaccccaatcagtcatagatttgatctctttacataatcacatagttcttggaggttttgttcattcctttacattcttttttatctattcttttctgccagtcttatttcagaaaaacagtcttcaagctctgaaattctttcttccacttgatctattctgctattaatacttgtgattgcattgtgaagttcttatactgtgtttttcagttctatcatgttcctctctaaacttgctattttggctgtcagcttctgcattgttttattatgatttttagattctttgtgttgggttaaaacatattcctttagctcagcgaagttcatttttatccacattctgaagcctacttctgtcatttcagcatctcagccttagccctgttttaagcccttgctgcagaagcactgtagtcatttagaagaaagggggcactctggttttttgagtttttgacatttttgagttgattctttctcatctttgtgggcttatctacctttgatctttgaggttgccaacctttggatggggttctcacagggattttttcttgttgttgttgttttctgtgttttttttgttgttgttgtttttctttgaacagtctgatggctgttgcatagggctgctgtggtttgctgggagtctgctccagaccctagttacctccgtttttcctgtacctggaggtatcaccaccgaagtctgcgaaatagcaaagatggcagcctgccccttcctctggaagctccatcccggggggtacggacctgttgccaggccaaatgcagttgtaagaggtacctgaagactttgtttgggaggtctcacccagtcagaagaaaagtgatctagtacctgcttaaagaagcagtctggctgctttttgatagagcagcatgcgtgttggggatctcttcagcctctgatcagattgagcaccccaaagcccacaagctggactggctaagatgcttgaacagccaaggtagtgacatgccccacccccagggcacttcatcccagggaaagatcagaactgttcataccgtatgtgcaggttgaggtagctggaggcccagctgggaggtctcacccaatgagggggaatggtttgaggtccagcttacagaagcaatctggccacattctggcaaagcagctatgctgcactggggaaactcttcctcatccagaccatttggactcttcaaagtccacaggctggaacagctgagtcaaccaaacagcagagatggcagcctgcccctcccctcagggccccatttcttctcaggcaggcacccttttactgcaggctggctggaattccaagccagtgggtcttgtcttgtgaggtgccatggaagtgggacccacaggccaatgctgcttggctccttgggttcagcccccttcctaggggtatgtacagacaccgtgcattgcctgggctgcagacacctttgttggggatcccaggactggagtatgtaaagctcctgggtctcagtgcatgcctgagcagcttctctgccaagactccacatagctctgtgtgtcggacccaaggccctggtggtgtgggctcataaggggatctcctgatccgcaggttgcaaagatctgtgggagaagcgtggtttcccagggtcgcacaatcactcactgcttcctttaactggatatgggggttcccttggccctgtgtcacacccaggtgggccatcgccctaccctgcttttctttcttctccatgagttgggttatttccctgaccaatcccactgtggatagctggataattcagttgaagttgctgtatccactcaccccagttcataaccaagccttatcacttgttaatctcctgagtaacacagaggtatctactttattctactttgaccaccacaaccttaggccaagcttgtctggctcatcttgtctgggctcctgcaccagccatcctatctattcttagtaacccagataactttttctatactcttacttcaactaaaaaaaaaaaaacttcatggaagtagcctagttacatttaaccaaattaaataaataacattttaaccaaaaccacataaatatatacatatatgcgtgtgtgtgtgtgcatgcgtgtgtgtgtgcttacattgcttcaaagataatgagctcttatgttgctatatttccctatattctttatagtaaatcctacaagatttacttactttttgctaccaacccccagtactaaataagctattcgtgggtctcactctgctagattctcatgtacaggagagtgtctgtgtcctaggtagtggtcatagatattgcttccaatgttgctgatttcagtaccataaagaagatatagcccagtaaatggaagagcaaagtagaatgaaatttttaatagctttgctctcttagtgctttgtctgtaagaatcactgttgcacttgacatttgttgccattttgctttttcattttgaattgtggagccagactgtgtctctatgttgaggggaggagaaggaatgacctcagaaatgtcagaattattactaatggcagcctttaagcttggataggtgggtaatagtgcttgaccaatctgcttaaatgctgactgtagagtagcgacctgaaacaatagtgggaagctatttaaaatttggaagaggcaaaatatgtgataggaaagatgtggcttattttcaagtacaggccacatggtatggtagcagcagatgccgtaaggaataagggcagcatctgagcagacctaaatgtaatctcacctctgtcattttcctacttgtgacactgggcagggtccacaatccctctgagccatcacctttcttgcatgtaaaatgaaatcataccactcactcaaggggctgttgaaaagattaatgacattgtgtatacaaaattccagccaccatagatgccagtttgcttttttctccctcgcttctgttttaacattgcagataatttacactaacaggtgatcaaggactaggcctaagccttcttctaagagactagcccagctcacagaccttgaagagacagtgtaattcactgcagagggctttctcccacttcttcctgctaaacaagttcctggagaggtttgaacaggcattagagatagtcggtggtacttgtccatatgcaatgctgtcagatgaatttttctatctgatgcagattggtccgaggccagcttcttgaccttaggttgcaagtggtgactaggagcagttgttcctgacaacttgtgttcttgcacatggctcataaccaaggataagacagcctccagaccatatatcctagaaataaatctagatatttctactcagactaatttttctctaaggggacagtgaagctcttctgggactgatccacctatctggcctcattccaggacaggcagaaggccttatgctgaatgcttactcaaggcctaagacagccaagacaaatagacttaacatgcttgacaactaatctactggtagtggctgcctagctagatatttgtagaattcccagtcctcttctgggcttagcataaattgtgtgcctcgatcagtgatgatgtctcccatagttactgcggagggttctcaaggcacacatgacagaattggaaacctcattatctggggatcctcaaagttccactttagttcaataaggatactggccattattcaagaactggtcttagtcacacacacaaaccatagtgtcatgactgagtaactcctcgagctgggtgaaaacaccatgaacacaataaacaaagacaatctcaattttttatcaatgcctcaaaagcttccagacccacaaataatttcaaatgtcaccagggatatatgttctgcatactacctagtccctcacaaccttgtgattctgggaactcagggactttcctggcgtcacttgaaatcactgaaagccaaggctagccctggtgcttttatcatcacttccagcagcctcccttaggtaggaaaacactggagtacaaaagaaaacaaaatatactgttcctaacacagaaatcccaggactttgaaatatttagactttttcagcccaaagcccacctgtcttctagcctgctgcctgagctattgatcttctgccaggtacatgtattcatgatcagtcaaagatgtcatcccatggagaatttaatgaaagaaatctacggaagggctccatctacccatctctacccatctattgtctttcctccttgtcaagaggagaagcaaggatgcacatctgtgcaaagagcaccaggtgttaaataaaatcattacctaaaaccaataccttcccatggactccaggatttcagtattagcacaggtgaactatagtttacaccaaacgaggattcctgaaaacacataactagccagaatcatgaaaagttataaaatatctttttattatgaccacattgagtacatattagagctgctcagacttttccatttggctattacataatctgaatgttgggtgatatttttattcttgctctcctcactcattaaaaactatgcagtgccattataaaaacaatattaataaaactagacagcttcccctctgtattttaaagcagtaaaaacattatttggcttctcatttacatggcagatccgattcatcatgttgacatagttaaacagaagaagaaatatttcacatagatagcagtgtcaaagcagtcagttctagaaagaaagtagtaatttaaaaaaaaaagaaaatatggaatcaatgaatggaatcataacaaagacattttcaatatcacatagaaaatcatgattatttgtaggtaaaacaaagtgaaaactaaagtgcacttatatttaaaattaaaaagattaaagaaactggtttcttgaaaagagcatcatatatttaaaaactaaaataaagagtgcaattaaaaataattcaaaacattttcagggacaaaaaaaggaaatatttaacatttattataatacctgagttttccttccttcatgaaaagagtactgaaaatcattttaaaaaaatttagttctaaataaaatagattcaatagtttttaaagatcactgaaaattgctttggaattgaagaaaataacattgaatgatttatagcttttaggagagatgggatacaagtcaatgacctgaagaaatggaaagaatgaagactcaggaaataaaacagaatgaaaaagataagaatattccacagagaagttagataatataagtgtagctttgggggctcagattaggaaaaacggcattagcttttgttttttgcaaaaactctaaaaggagcttaaaaatggtttatttttccacagtgcaggagtgataagacacagttttcagtgttttaagtgtctgtgtgtatgcatatatgtgtgtgcatgtgtatgcatacatatgttggtatgtaaccacacgtgtacatgcaaggatgtgactatggagactctaggtgctttgatcctctgtatcatatatctctcaagttaagaaaagggtattccccatcctgctcattggaaggtgcagctgaggtgatgttttcttctattattttcctttcggcttcttgctccaattcttctatctcctgcaggcgtttttccaataactcagcctgcctcttctgtttatttttcagttttttctttttgtttttagatatttttcctataggtttctgctgtggagccgtactcactgcagaccctgaaggaggaggaatacctgctttctgcccctcagtggtctcagctgccgttcttctcacatatgcatcatccatacacatcaagatgttttgcggctttatgtcagtatgagtaatcttggtcttactgtgtagatattctaacccttgaaggaaatgtcaaatgatactcttcagacaacgtactgggtgggaggccttgatagttgaacttgatgatccagttgaggagatggtggccaagtactcccaagaccatgcagacatgtatcccattcatgcctgaaatcttgaagtcaacgagctggatcaccatgtctttgtttgggtcactgggataactttctcgaacacatttgagcaattttatttcatccaaggctgtgtctgtatcacgctgagcactttttacaactttcattgcaacaaatcttttcccctacatatcccagcacagccagacagtagagaagtgcccccatccaagctttctaataacatgataccggccattgaagaggtctgcaattttcactggatgatagccacctttgcagtagtccgcagggtcctcttgctcatcatctgatccaggatctcctcctttggctctggtggtgtggggtctgccaaaggtggcggtggtggtggtggaggtggaggagaaagaactaaaggagctttctgttgaggctccagctttgtagggtgtttctctcttttcggcctccgcttttgggcctgaatgggcaacactttcctggagctcattccgacgcggcgcaagcggggctacaggggcttcgcggaggtgatggcgacgcgagcgcggaaaccagccgggctgcggctttcacttgctcaaccgaccgggaggaggctctggcggatggcgaatactgcgcagaagtgaaactaaaaacagcaggattagaggaggcggccgaggcagacggcaaaggacaatgctgaagctgaggaccaggaagagaaagaagaccctgagaaagaaaacattgagaaagaagatgatgtagatcaggaacttgcgaacatagaccctacgtggatagaatcacctaaaaccaatggccatcttgaaaatggcccattcttactggagcagcaactggacgatgaagaggataatgaagaagaccgcccaaatactgaggaatataatcttgatgagccaaatgcagaaagtgattacacatataacagctcctatgaacaattcaatagtgaattgccaaatgtatggcataaaattcccgagtcacagtttccagagttttccacctcgttgttttctggatccttagaacctgtggcctgcagctctgtgctttctgagggatcaccacttactgacagaagcaggacggtttcagcctccagtactggggatttgccaaaagcaaaaacccgggaggctgacttgttgatgaatcccctggatacacggaatgcagataaaattagagtagaaattgctgacctgggaaatgcttgttgggcgcataaacacttcacggaagacatccagatgagtcaataccgttccatagaggttttaataggagagggatacagcacccctgcggacatctggagcgcggcgtgtatggcatttgagctggcaatgggcgattatttgtttgaaccacattctggggaagactattccagagacgaagatcacatagcattgatcattgaactgctggggagagtccggtttactgaccgttttcttctggaaaaaaatacgctatgttggggaaatatttcgaggagtttttcaccagaaaaggagaactgcgacatcaccaagctgaaaccctggtgcccttttgatgtacttgtggagaagtatggctggccccatgaagatgctgcatagtttacagatttcctgatcccgatgttagaaatggttccagaaaaaacgatcctcagctggcgaatgccttcagcatccttggttgaattcttaccaaattctaccaatactgcattctgagctagcaagtgttcccagagcgttggacataaacggtgactctcattctttaacaggattacaagtgagctggcttcatcctcagacatttattttgctttgaagtactgttgtttgacattttgctttttgtgcactctgatcctggggaagagcagtcttttgacttcccttagtggtttactgaccgttttcttctggaaacaataacgtgtctctaagcattgtttcttgtgttgtgtgacatgcaaatgtcatttttttaatgagaaatactttcccctttgtgttttggcagggtttgtgactatctatttatgaaaaataaattttagctgagtactatattattgataaccttaagaaattatcaagttggaaccaagaaatagcaaggaaatatgcaatgttatcttctggcaaagggacatcattcctgtattatagtgtatgtaaacacacactgtaaatgttactttccattaaacatgggaggggggctcaaatttcagaaaagctaccaagtcttgagttctatgtagcatatgttgcatgtagccgactttaactgcttctaggagttgtgcaagcttttcattccataacagtcctttcacattggatttttaaaaaagtggctccgggttgtaagatatcattctctatgtggcactttaaaggaagaaaaaataggcttctcattctaaaatatgcataataatttagcagtcccatttgtatttttgcatatttttaaaagtatttttaaagaaaaagagggatttcactttaaaaatgtaaaggcttagtaccatgtcataatgcctcctctgggcactgtaacttaagctccacatagattaaattggaaaagagaaatgtgttcattgtgtcgaatgaaaaaatacatatattttcgaaaaagcatgatcatgcttgtctagaacacaaggtatggtatatacaatttgcagtgcagtgggcagaattctcctcacagctcaaaggtaacagtgatcatattcattccgtaggtagctttatgtgtggctacaacaaattttagcagcttttttattgtctttccatgaaatgaagttgagaaaatgattttccctttgcaagttgcacacagttttgtttatgcatttccttaaaattaattgtagaatccaagacacaaaccacaggtggcaatacaattttagaatgtaacatatagaggtatatttagcctgttttagaagtcagtggattcaatgtctttttactttaaattttacattaattaaggtgcctcattttttactttgtccattaacatttatccatatgcctttgcaataactagattgtgaaaagctaacaagtgttgtaacaataatccattgtttgaggtgtttgcggttgtcttaaaaattaaagtattggccaggcgcagtggctcacgcctctaatcccagcactttgggaggccgaggcgggtggatcacgaggtcaggagatcgagaccatcctgactaacacagtgaaaccccgtctctactaaaaatacaaaaaaaaaaaaaaattggccgggcttggtggcgggtgcctgtagacccagctactctggaggctgaggcaggagaatggcgtgaacgctggaggcagagcttgcagtgagccgagattgcgccactgcactccagactgggcgacagagcgagactccgtcttaaaaaaaaaaaaaaattaaactgttttgttttgctttgtttccagaaaaaaaaaaaaaaaagaaaagggtaaagagagtaaccatagggtctctatttttcgtattcaagaagcagtcagaacacccgaatgattaaaaacatgatctttagagtcatacgcatctgggttagaattctgacatttcactgctacatcatgtcatatcaggcaatttcattagtcttctcatgtctcaatttcttctttacgaattgaaaaatggtagcaacttcttcataagactgttttaaggattgaatgagatcatgtataaagccctcaacatagtgcctagcacagtgtataatcagtacatgatattcactgtaattattatttttactgataaatgtaccaagaatgaaactaaaaaaagacacaccagaaagtccagcaaaagaaaataggagataggaggagagaactgagaattgattgaccaatgtctgtcatagctcaaaagacttatgcaagaggaaccaaaagcctccactcatccatgactgctctcttctcagcaaggctgtgaccacacagtcaactcagaggatgggaatagtgaggttccacaataaatttcatactaaaacgcactgcccagtagcagaaacattagctgataatgatgaatccaatagcctagcgtttaaccgatacatttaaagcagcatatgacatatttttcataactacccttcactggcagtctaaaaacaaagaataaaaagcttctctttgatcaaaccatgttccaaaatgaaatagatccctttgttttatgtgtatgagtatatttacactgaaaatatatacatatattcacaaatacacgcacagagcaatgtagtacatgcagctgtgtaagaataaatggctttaaaacatatcagcaaatcaacaactgaatcattaaactgacaggaaaccttgttcaagattcccatgtcattttgcaaagagtgtactggatctgactagaatgcattaagagaccagggtgtttggagtttgaaaaacatctttaaaggaaaagaaagagaagtatgactgttagaaaaggaagcagatattctcaccagaataagaagtcaaattatgaacacttgagctttacaactgctttaaataaccctctatggtgaggcataagaactttaatgaaagcaaaaatcatttcatcatactgatggtatagagtatttctttttcttttcatggtttcttctttattcttagttcatttccttttttttttttccttgtgacctggtatttgcttctattataaactaagactatgctagcaaaagaaaatggaccaaggaggcatttatctgaataattcaggcagaaacaatttatacttgaagtagcaagaagttttagacaaaggagaatttttgcttggattaaccctcgacctggttcagcttcagactaaaataatgatgatacccgtggtgctgtaactttgattcagccagtgtactgaatagtcggccctgtgctttgggaccctgttgtgataatgccagcattttcatgcatgtgaatgcttacttttgaacaccgttactcagttcttatatcctgaaaaacttagtgagggaaaattgcatgcattcaacgtttataaaccctgataagctcagtttctaaacactggcatgagtgttgactggaagggctgtcatcggaggccctgccttatgagaacatcatgcctagtatttccataatctgccgatagactgcaagtgatggatctacagcaggatgaagacttctgaattagcattcaggcctttctcactgttgctcacagcagagacaggagagaaggggaaaaaaaaaaggattagatcttttctccttgcccctgtagttttcttctggcagtagactctgttgatgggaatgggcctgataatcgcaactacgcagaataggagagtggggtatgcctttgttggcatgtcctctgaaatgacctcggcaaagaatgctgtggaaaagaaatggtgattctaaagaaaaggcatttgtaactttttttaataaattttcctttaagttttggaatacatgtgctcaacgtgcaggtttgttatataggtatgcatgtgccatggtggtttgctgcacctatcaacccgtcatctaggctttaagcccagcatgcattagatatttgtcctaatgctctccctccccttgccgccacccggcgccccccgccccctgacatgcgcaggtgtgtgatgttcccctcccggggtccatgtgttctcattgttcaactctcacttatgagtgagaacatgcggtgtttggttttctgttcctgtgttagtttgcttttaaaatatttgaaagatgaaatattagaagaaaagaaaattgttttatggaaatgtttctccaataggcaaattaggttagaatgaagattaatgatatctaaccagagaaatcaactcagtggactccaccaaatcggctctcagtgcggctaaaacaaagcaggcagaaaaaggcagagaagcagcttgctgggtctacttgcaccagcaaccccttgcggggggtaggtggggctcccaggcctttggcctcagactgagggcggcactgtcagccccgttttttttcctttgtttgtttctgtttttgtttttgtttttgttttgagacagagtctagctctgttgcccaggctggagtgcagtggcgcgatctcggctcactgcaagctccgcctcccgagttcacgccattctcctgcctcagcccccccgaagtggctgggactacaggcactcgccaccacgcccagctaatttttttgtatttttagtagagacggggtttcgccgtgttagccaagatggtctcgatctcctgacctcgtgatccacccgcgtcggcctcccaaagtgcttggattacaggtgtgagccaccgcgcccagccccagccccctttctttgaggcttttggatgtggactgagccactccaggcttctcttcttcaccagcttgcagacgacctattgtgtgactttgccttataatcctgtgagccaagtctccctaataaactctattttgtatatatatatctatatctatatatagatatctatagatatctatatatatatctatatatagatatatataaatatctatagatatatatacatctatatatagagagatatataaactctattttgtatgtatatacacaaaatatatgcatatactaaatatatacactatatatgtacaatatacattgtacatatatacaatatatgtacatatatacaatatatacatattatattgtatattgtatatacatatatattgtatataatgtacaataagtacaatatatacaatatgtacgtatatatgtatatatgtacaatatgtacatatatatactatatatactatatatacaccatatatagtacatatatatacaacatatacatatacaatatatatacaaaataaactctattttatatatatatctatatctagatatatatagatatctatatatctatatctctctatctatatatctatatatctatatctctatatctatatatctatatatatctagatatctagatatatagatatatatagagagatatatattgtattgggtctgtccctctggaatgccctggttaatataaggacttttaaagaaatagatgtgcattagagatgagaaagaatggaaatcactaaatgaagccgtcttactgtttagctttggaaaagtagttcgagggaaaagttttagatttctcttctttagcacaacaaagatcatactgggaaaaccagactcaaagactgactgtttcagtcttattgaggtaacattgacaaacaaaaattgtatatattcaaggttataatgtgatgttttgatatatgtacacattatgaaatgactgacacactcaagctattaacacatccaggctgggtgcagtggctccgaactgtaatcccagcactttgggaggccaaagtgggtggatcacctgaggtcaagagtttgagaccagcctggccaacatggtgaaaccccatctctactaaaaatataaaaaaattagccagacctggtggtgtgcacctgtaatcccagctactcaggaggctgaggcaggagaattgctcgaactcagaaggcagaggttgcagttggccgagatcttgccactgcactccaacctgggtgacagagcgagactctgtctcaaaaaaaaaaaaaaaacaaaaacaaacaaacaaacaataaaagccattccctcacatagttaccattagtgtgtgtgtgtgatgagaacacttagtatctactttcttagcaaatttcaaatgaacaatattattaactgtagttaccatgctatacattaggtctccagaacttattcattttataactgcagaggggctgcaaacagctgaagtcagggcatgggatgcccttctgggggccaagcccaaggaagaatgtggcagaagaggaattcgggctttgggaagggagcagggcatggaacagttgaaggtagcagaagatgcctatggaatccctcctttaacttttcatatctccagtaaaattgccattttcaccacttgtggaaaatgatgaggaatcagtgatctgaccaatctagaatatctcagctatgctttattcaggaggcaaattaatttagaaaggaaattaataatacttaactttccaaaaaatataaatggaatccacataggaatttgaaacatagtcatgcattgcataaggacattttggttaatgacaaaccacatatacaatggtggttccatgatattatactgctatattttacttttctatgtttagataagttttgatacacaaatacttaccattgtgttccatctgcccacagtattcagtacagtaacttgctgcacatgcttgtagcctagaaggaatagcttataccatatagcctagatgtatagttggcaacaccatctagttttgtgtaagtacacttcatgttgcctacacagcgaaaagcacctgatgatgccattgtcagaaggtatccctgttgttaagcaatgcatgactagagcatatttgtatctgcaaactcaggacagagaactctgtggtgacatgtagtgcaaggaatttgctgaagtcttggggagtacttaggactaatattcattttgagccaagtattctaaacctctgagagataaggagatcccagtaacatctagggtatgtaaagctcatgcacaacagctgagatctcctcacagcagcacagctgaaagtgcaaatgcaggagcatccaactggactctcactgttcatgtcccctcctgcccaagcattagaatctagaactcacttcagtttttgagcattgtgttaccattgtgtgattttgtttttttaaatgaataagaaagacacaactctgccaaatggcattgtgaacagaagggttatttctcagagggtaaggagtgagtaagtccacatatgccctcagtcaagagagagtgaaaagaattttcaactcagaatttcatatccagccaaattaagcttcataagcaaaggagaaataaaatcctttacagacaagcaaatgctgagggatttcattaccaccaggcctgctcttcaagagctcctgaaagcactaaatacggaaaggaaaaactggtaccagccactgcaaaaacacaccaaaatatgaagatcaatgacactatgaagaaagtgcatcaactcatgtacaaaataactaaatagcatcataatgacaggatcaaattcacacataacaatactaaccttaaatgtaaaagacacagactggcaaattggataaggagttaagacaaatcagtgtattgtattcaagagacccatcctgtgtgcagacacacataggctcaaaataaagagatggaggaaaatttgccaagcagatggaaagcaaaaaagtggcagttgcaattgtagtctctgacaaaacagactttaaatcaacaaagaacaaaaaagacaaggaagggcattacataatggtaaagggaataattcaacaagaagagctaactattctaaatatacatgcacccaataaagaagcatccagattcacaaaacaagttcttagggacctacaaagagacttagactcccacactataatactgggagattttaacaccccactgtcagtatcagacagatcaaagagacagaaaattaacaaagacattcaggacttgaactcaactctggatcaaatggatctagtagacgtctgcagaattctctaccccaaaacaacagaatatacattcctctcagtaccacatggcacttattctaaaattgaccatataattggaagtaaaacattcctaagcaaatgtaaagaaactgaaatcataacagtatctcagaccacagtataatcaaattagaactcaggaataagaaactcactcaaaaccacacaattacatggaaactgaacaacctgctcctgaatgactcctgtgtaaataatgaaattaaggcagaaatcaagaagttctttgaaatgaacgagaacaaagaggcaatataccagaatctctgggttatggctaaagcagtgttaacagggaaatttatagcactaaatgcccacatcagaaagctagaaaaatctcaaattgacacctagacgtcacaattaaaagagctagcaaggcaagaacaaacaaaaccaaaagctagcagacaacaatcaataactaagatcagagaagaattgaaggagatagagacatgaaaaaccctccaaaaaatcaacgaattcaggagctggttttttgaaaaaaactaacaaaatagataaaccactagctagactaataaagaagagagagaagaatcaaatagacacaataaaaaatgataaagagatttcaccactgaccccaaagaaataaaaactaccatcagataatattataaacacctctacgcaaataaactagacaatctagaagaaatgataaattcctggatgcatacacactaccaagactaaaccaagaggaagttgaatccctgagtagaccaataacaagccctgaaattgaagcagtaattaatagcctaccaaccaaaaaaaccccaggaccagatggattcatagctgaattctaccagaaatataaaaaggagctgaaactactccaaacaattgaaaaggagggactcctccctaaatcattttatgaagccagtatcatgctgataccaaaacagggaagagacgcaacaaaaaaagaaaacttcaggcaaatatccctgatgaacatcaatgcaaaaatcctcaatgaaatactggcaaactgaatccagcagcacatcaaaaaacttatccaccaccatcaagttggcttcatccctgggatgcaaggctggttcaacatatgcaaatcaataaatataatccatcacataaacagaaccaaagacaaaaaccacatgattatctcaatagatgcagaaaaggcctttgataaaattcaacatcacttcatggtaaaaactctcaataaactaggtattgatggaatatatctcaaaataataggagctatttatgacagacctacagccaatatcctattgaatgggcaaaagctggaagcattccctttgaaaaccagcacaacacaaggatgccctctctcaccactcctattcaacatagtattggaagttctggccagggcaatcaggcaagagaaagaaataaagcatattcaaataggaagggaggaagtcaggttgtctctgtttgcagacaacatgattttatatttagaaaaccccatcgtcgcagcccaaaaactcaaacactccttgaactgataagcaacttcaacaaagtctcaggatacaaaactaatgtgcaaaaatcacaaccattcctatacaccaacaataggcaagcagagagccaaatcatgagtgaactcccattcacaatggctacaaagagaataaaatacctaggaatacagctaacaagggaggtgaaggacctcttcaaggagaactacaaaccactgctcaaggaaataagagaggacacaaacaaatgaaaaaacattccatccttatggataggaggaatcaatatcgtgaaaatggccatactaccaaaagtaatctatagattcaatgccattcccatcaaaccacaattgacattcttcacagaattagaaaaaaaactattttaaatttcatatggaatcaaacacctcgtatagtcaagacaatcttcagcaaaaagaacaaagcttgaggcatcacgctacctgacttcaaactatactacaaggctacagaaaccaaagcatcatagtcctggtaccaaaacagacatataggccaacggagcagaacagagacctcagaaataacaacacaaatctacaaccatctgatcttcgacaaacttgacaaaaacaagcaatggggaaaggatctcctcctattcaggaaatggtgcttggaaaacaggctagccatatgtagaaaactgaatctggacccatcccttacatcttatacaaaaattaactcaagatggtctaaagacttagatgtaaaattcaaaaccataaaaaccctagaagaaagcctaggcaataccattcaggacataggaatgggaaaagacttcatgaaaaaacagcaaaagcaattgcaacaaaagccaaaattgacaaatgagatctaattaaactaaagagctaatgtacagcaaaagaaactagcattagagtgaacaggcaacctacagattgggagaaaatttttgcaatctacccatctgacaagggtgtaatatccagaatttacaaggaatttaaacatatttacaagaaacaaacaaccccatcaaaaagcgggcaaaggatatgaacagacacttctcaaaagaagacatttatgcagccaacaaacacataaaaaaagttcaacatcaccgatcagcaaatcaaaaccacagtgagtcaccatctcacaccagtcagaatggtgattatcaaaaagtcaggaaacaatagatactggtgagggtgtggaggaataggaatgcttttaccctcttggtgtgaatgtaaattagttcaaccattgtagaagacagtgtggtgattcctcaatgatctagaatcagaaataccatttgacccagcaatcccattactgggtatatacccaaagtaatataagtcattctactataaagacacatgcacacatatgtttattgcagcactatttacaatagcaaagacatggaaacaaacaaaatgcccatcgatgatagactggataaagaaaatgtggtaaatatacaccatagaatgctatgcagccataaaaaggaatgagatcatgtcctttgcagggacatagatgaagctggaacccatcagcctcagcaaactaactcaggaacagaaaaccaaacaccccatgttctcactcataaatgtgagttgaacattgagaactcatggacacagagagggtaacaatacaccagggcctattgaggggtgggggtgaggcaaggaacttagaggatgggtcaataggtgcagcaaaccatcatggcacacgtatacctatgtaacaaaactgcacgttctgcacatgtatcccgtgtttgtttgtttggaagaaataaagaaaaaattttcaataaaagtttggggtttttaactctcaaaaaaaaaaaagaaaaggagagagagagagtgaaagccaagctaccctgccttgaaggggtcaattaggaagaaccaaactgaaagtaaccagcaatcctttattcattgttgtagtgcaggccaggatgaaggtgccagctcccacagtgttgcacatggccagggtggtctcacggccaaaggagctctgaaccaaaggctcctcctatcttatggacccagagaggaagaggaaaggactagtagtgaaaaaaatacaaaatacccattcaaagttaagaaaattttcttcaagtctcccccaataaggtgttctcagcagatgcacccaaagctaggggcagcccaattaggcggcctcggaatggaggcacttaaggtagaaatgcaaatacacgagacagggtcagctgtagagttgaggggagtgggggtcaggatctgagtccttgactgcacttcccttcagggatggcagagcactagctgatgtggggagggcagcttcccccatgagcctgccagataatgacttggaaacctcctatggtttgacatgaaaggtcacacataggatcttggcctggagccagacacctcatttcctggttgaaatttgtaatgctaaaattttaagttacgcagtcctacccaaatctgatatttttattttcacaacacagtttccttcattttcctaatggataaatggacggcttattttcatatgaattgatagtatcaacaaagagaaagaaacaaagagatcaggccaggcgcagtggctcacacctgtaatcccagcactttgggaggctgaggcgggcagatcacctgaggttcggagttcaagaccagcctgaccaacatgaagaaaccctgtctctactaaaaatgcaaaattagccgggcatggtggcacatgcctgtaatctcagctactcaggagactgatgcaggagaatcacttgaacccgagaggcagaggttgtggtgagtggagattatgccattgcactccagcctgggcaacaagaatgaaactccatctcaaaaaaaaaaaaaaaaagacacaaagagatcaaatacgggactttgcatttcagccaataataaaatatgtgcaataatttgctttgtttcaatcttctcattttcttcaggtgttttagaatactaagaggaatttttagtaaggaaatatgtagattagatgtttgaagagaatatattgatttgacaattctaaattttttttctgaagaatctgaccttttacaaaatcccaatgaagaccatactccactgaatcaaataatccttttcttatcaattactatgtcccctcagagaaggcaaaacataagtatgtaattttgctgctatgacagacagaagagtcttgctggaggccactggcaaacacattaatcactgaagcacctcaactcctcggaccctcaataaatacctctaccccctaagagagatttactgttgttgtgttctgttgttgtgtttttattattattattattattatactttaagttttagggtacatgtgcaacgtgcaggtttgttacatgtgtatacatgtgccatgttggtgtgctgctcccattaactcttcatttaacattaggtatatctcctaatgctatcattttcccctccccccaccccacaacaggccccagtgtgtgatgttccccttcctgtgtcctgtgttctcattgttcaattcccacctatgagtgagaacatgcggtgtttggttttttgtccttgtgatagtttgctgagaatgatggtttccagcttcatccatgtccctacaaagaacatgaactcatcattttttatggctgcatagtattccatggtgtatatgtgctacattttcttaatccagtctatcattggtggacatttggcttggttccaaatctttgctattgtgaatagtgctgcaataaacatacgtgtgcatgtgtctttatagcagcatgttttataatcctttgggtatatacccagtaatgggatggctgagtcaaatggtatttctagttctagatccctgaggaatcgccacactgacttccacaacggttgaactagtttacagtcccaccaacagtgtaaaagtgttcctatttctccacatcctctccagcatctgttgtttcctgactttttaatgatcgccattctaactggtgtgagatggtatctcattgtggttttgatttgcatttctttgatggccagtgatgatgagcattttttcatgtgtattttagctgcataaatgtcttcttttgagaagtgtctgttcatatcctttgcccagtttttgatggggctgtttgtttttttcttataaatttgtttgaggtcattgtagattctggatattagcccttttccagatgagtagattgcaaaaattttctcccattctgtaggttgcctgttcactctgatggtggtttcttttgctgtgcagaagctctttagctgttgtgtttttgttgctgctgtgttatactgttgtgtttttgttgttgcattatgctgttgtatttttgttgaacaggaggcatgcatgagcacagctgtctatgggtgggtccaaatgtgggagcttggtgtttggcttgcccctgtgaatagccccatcctgtctgcttaggccaatgctcccacctaacagagggactgttccccaggaaggtcagcagcctttcatgggagtacatgttggtttcaggtcaaatccatcccccagagaattgcaatatcatacacagagaatgtattgcagtgtctgaagagagttgcaccaaggactcagaatctgactcccaccccgtcaactggccatagtcttgtgcatgtcttcattcataccttacatgcctccattccaagtcctccatattaggctgcccttagccttgggtccatcttctgagatcaccttattaggaagcaatgaagaggtggcagaagctgcttaaactttacagcctcctccgagtaagagatcgccagtccctacattaagatgagcatgtaataccacatgccagacattaaccaatttatttataattcatttaaacataaattttgtgcatgagctaggtgttattattattatttatcttacttttagatgtggaaacaaagaggcagagagagggaaaaacttggccaaggaaacacatgtaataagtggtaacactgggatatggctccaagctgtctggacgttttaccaccatgccaaacccatctctcagtgaagccaggggactgaattcacacaggtgtttgatatcatccaatgcctccaatcagatgacttaacagaagacagatcctttctcaaaagcaccacagttacctacacaacaaaaagatttcatttaaaacctagcatcccatcctcctgccaagtctgggcccaaaacttagcatgaagtgaaggggcttacatctttttacaacaaagtgtgggatgagaagagatagaggaccacagttaaattgagaagatttcttcaaaattgcacactttaagtagattgatctttttcccttaaaaaaatggaattttaaaagatttacttacagctttgtgcacacttacatcctcctccagattcctctgttttatgacaaagacaacacaggacatagatggtttaggcatcttccctatggggactccagatagaagattcctattccacataactttatcctacttgtcaactatcagagtccaaaatctactaaatactgtaggagggtgggcatggccaagcatacacgtgctgaaactacatggttaattttaaatttgattaaagagcacatagaaaatcatttctgtatatttaatttacatgccatatacccactccccacatatgcacagctttccccaccatcagtatcccataccaaggggtttatggaaactctctgtactttctgctcaattttgctatgaccgtaaaactgttctaaaaaaataaaatgtttaattaataaaaattctgcatcagagtgttacatttattacaagtgtaatatattgaacatcatcattaccaaaagcccatcattttacattagggttcactctggcatttacattagggttcactcttgacactgtacattctatggatttggactaatgtataatgacctccatccatcattatagtatcatacagaatagtttcattgccctaaaaaatcccctgtcttccacctattcatctgttcctccctatagtccctgacaatcactgattcttttactatactcatatttttgccttttccagaatgttatgtagctgaaatcagtaagtagcctttttagactagctcctttcacttagtaatgtgcacttaagtttcctccatgtctttttactactcaactccaagatttggcataaaactacagtgataaaaggtgtgtggtactagcaaaagaatagacaaatagcacatcgctcaataggatagaatagagaacccagcaatagtcttcgtagctagtttctttttagaccgcatatttcattgtctagatataccacagtttatccattcacctgatgaaggacatcttggttgcttccaaattttggcaattatagataaagctgctataaacagccatgttcagatttttgtgcaaacatgttttaaactgttttgcatgaataccaaaaggcgtgattgctggatcatatggtaagaatatgtttagttttctaagaaactgccaaactgtcttccaaagcatctggaccattttgtattcccaccaggaataaattaaagtttctgttgaactcagaatcctcaacacatcctcaccagaatttggcgttgtcagcgtttttggaatttggccattctaataggtgtgtaatggtatcccatcgttgttttaatttgcaataccttagtgacatatgatgttgaacatcttgtatttgcctacttacctctgtatatcttgtttggtgagctgtgtattcagatctttgggccattttttaatagagttattcattttcttatagctgagttttaagagttatttgtatatttaggataacagtcctttatcagatgcctcttttgcatatgttttttcccagaatgtgacttatcttctccttctcttgaaactgtctcagagcagaactttttaattttaattaagttcagcttataaattatttctttcaaggaacatgtttttggtgttgtatttatttatttattatttaattttttagttttttgagacggaagctcgctctgtcgcccaggctggagtacaatgacgcgatctctgctcaatgcaacctccgcctcccaggctcagtgattctcctgcctcaatccccctagtagctagcattataggcatccatcaccctgtctggctaatttttgtatttttagtagagacagggtttcaccatattggccaggctggtctcgaactctttgccttaagtgatctgcccacctcggtctcccagagtgctgagaatacaggtgtgagccactatgccctgcctggtgttgtatttaaaaagatattgccatacccaagatcacctagattttttttttacatattcaaggaattttatagttttgtgttttacatttaagtctataatgcattttgaattaatttttaaggagtgtattcatatttttgcatatggatgtcctatttttccaggatcatttgttgaagactatctttgctccattatgctacctttgctcctttatcaaagatcagttgactatacttatgtggggctgtttctgggctctctattctgttccattgagctatttgtctatttctgtgccaataccactctctctattactgtattactttattactaaagctttatactaagtcttgaagtttggtagtaacagtctgccaacttttttcttctttacatagtgttggctattctaggacgtattgctctccatataaactgtagatttggttgtttggcatccacaagataactttctgggattttgattggaattttgttgaatctatagattaagttgggaaagactgacatggtgatgatattgagtctccctatccacaaacatgaggtgtgtcttctattatttagtcttttgatttctttagtcagagctttgtaattttcctcataaatatcttgtgcatattttgttagatttatacctaagtatttcattttatggggttctaatgtaaatggtattgtgtttttaattgcaaatgccacttattcattgctagtatataggaaagtgattgacttttgtatgttaactgcttatctgcaaccttggaataattgtttattatttccaggagttttatgggttttttttttttttttcagattttctacatagaagatcatgtcatctgtgaaaaaagacagtttcagttctctgttcctaatacctcttatttatttttgttgtcatattacattagctaagaatttaagtacaatgttgaatagaagtggtaagaggaatatccttgccttgttcttgatcttagcagaaaaacttataggctgtcatcaaatatgatgttagctgtaggttttttgtagatgttttttgccaagttgattttgtttccaagttaattgatttttgctctaatttttattatttcttttcttctacttactttggatttaaattgctcttctttttctagtttcctaaagttgaaacttagattattaattttagatctttcttttttctaatacttgtattcaattcctagtttcttctcacttctagtttgctgaaagtttgtaattataaatgggtattggattttgtcaaatgctttctgtgtgcctatgatcctgtgatttttcttctttagcatgctgatgtgatgaattacattagttgatattagaaaagtaaattagccttctataactgggataaatctcacttagtcatgatgcagaactctttttatacattgttgaattcaagttactaatattttgttgaagtttttgtgtctatggcctgcagttttcttctcttgtaatgtctttgtctggcttttgtattaggataatgctggcctcctaaaacgagttagatcacataccctctgcctctattttctggaacagattttagagaattttttttttttttgagatggagttttgctcttgttgtccaggatggagtgcaatggcgcaatctcggctcaccacaacctctgtctcccgggttcaagatattctcctgccttagcatcctgagtagctgagattacaggcatgcgccaccacacctagctaattttctatttttagtagagatgggtttctccatgttggtcaggctggtctcgaacccccgacctcaagtgatctgcccacctcggcctcccaaagtgctgggattacaggcgtgagcccctgcgtcagcactaaagaatttatatcatttcttccttaaatgtttggtaggattcaccagtgaacccatttgagcttggtgctttttgtttgggaagattaattatagattccgtttctttaatagatatagccctgtttaaattatctatttcttcttgtgtgaattttggcagacatgtctttcaaggaattgatctggtttatctaggtggtccaatttgtttacaatattattctattgtctttttgatgcctatggatgtgtagtgatgtcccctctttcagttttgatgttagtaatttgtgtcttctccctttttttcttagcctggctacaggtgtatcaatgttattgattttttttatttctattcaatagcttcctattaaacttatggtttgttgattttctctactgattttttccaatttcattgatttttgctctaatttttattgtttcttttcttctacttactttggatttaaattgctcttctttttctagtttcctaaagtaggagcttagattatttattttatatgttgcttttatctaatgtttgtattcaatgctatacagttctctttaagcagtgctttctctgcatatcacaaattttgttgttttatttttattttcatttagtttgaaatatttttaaaacttcctttgaggcttcttctttgactcatgttatttcgaaggatgttgcttaatctgtaagtatttggagattttccagctatctttccatgatttatttctagtttaatcccactgtggtctgagagcagacattgtatgatttgtatgctttaaattgtgttaagttgtgttttatggcccagaatttgttctttcctgctgaatgttccatgtgagcttgagaagaatgtatattctactgttgctggatgaaatagtcaatagatgtcaattatatccatctgttgatggttgtgttgagttcaactacgttcttactgattttctgcctgctggatctgtccatttctgaacagggacattgaagtctccaagtacaatagtggatttttctatttctctttgctcttctatcagtttttgcctcacatatgttgatgctctttccttaggcccatacacattaaggattattatgttttcctggggaagtgatccctttgtgattatgtaatgtcgaactttatccctgataattttccttcttctgaagttggctctgtcaataattattatagctatttcctatttcttttgattaatgttaacatggaatatttttttccaccccattactttttatctgtatgtgtttttacatttaaagagggtttcttatagacaacatgtagttgggtcttgttttcagatccactctgacaacctctgtcttttaattggtatacttagatcattggcatttaaagtaattactgatatagttggattaatgtctaccatattcattgctgttttctatttgttacctttgttctttgtttctatttttgtcttccacccttttcttccttttgtggttttaattgagcattttatataagtttattctcctttcttatcagatcaattatactttctttaacttttttttttagtgattgccctagactttgtaatatacattcacaacaatttcatgtccactttcaaataacactataccagttcccaggtagagtgagtgcctcataatagtaaaatagtcctagtttatcttcccatgccttgtatcactacttatttattttactcatacagaagcatatgtaaacatatataatcaaatatattattattatgaataagctattgtctattagatcagttaagaataagcaaaactaaaatgtttattttatcttcacttactccttctctgatgctctttctttctttatgtggatacaagtttctctaacctatattactttacagctctctaaagaatttcttgtcaacaaattatctcaattttttattttataataaaatctttatttcttcttcagtttaaagggataatttcacagggtgcagaattttaggttggtgaaggtcttttcttaacagtaaatacttctctctttttaattttactttaagttctgggatacatgtgcagaacttgcaagtttgttacacaggtataccatagtggtttgctgtacccatcaacctatcatctaggttttaagccctgcatgcattaagtatttgtcctaatgctctctccctccttggcctccacccccgacagaccccagtgtgtgatgttctcctccctgggtccctgtgttctcattgttcaactcccacttaggagtgagaacatgcagtgtttggttttctgttctgtgttagtttgctgaggatgatggcctccagcttcatccacatctctacaaaggacatgaactcactcttttttatggctgcatagtattccatggtgtctatgtgtcacattttctttatcctgtctattattgatggacatttgggttggttccaagtctttgctattgtaaatagtgctgcaataaacatatgtgtgtactgaacactaaatatttcacttctctctcttcttgctttcatggtttccaaggataagtcagttgtaattcttttctcctctgtaagtaaagtgttgtgttttttttctgcctctggtttttttcagaacttttttccttatctttgattttctgattttaagttatgaatctctgtatctacctgcttctcttctatgataggcctgtatgtagtttttttggcatttatcctgttcttggagcttcttggatctgtgggttgatatctgatattaatttaagaaactcttcagtcattgttactgcaagtattacttctgctcctttctctcttttttctccttctgctcttcttattacacatattttataccttttgtagttgtcccactgtttttaaataacctgttcttgttttttaaataactgttattgtttcttagtttttttatttgctttttcattttgaaggtttctgttgatatatgcgcaagctcagagattttcctcagctgtgtctagtctagtaatgagcccaacaaaagcatcctttatttcttatacaatgttttttatctctagcatttccttttacttttttcttagaattccatttctctgcttacattgtccttgtgttttgcatgctgaccaattttttcattaaaccccttagcatattaataatagttgtttcaaatttttattccagtaattccaacattcatgccatttctgagtctggctctgatacttcctttgtctcttcaaactaagaagtttgaagttctcttttagtatgccttgtaattgttttctgatagctggacgtaagtgcagagcagaaggaaacatgataaatgtgcctttaacgatgtggtggtaaggtgtagggggaagtgatgcattttacagccttgcgattaagtctcagtttttgagcctctgaattgtgaccttcacaaataagtcttagttttttgctctcccacttagatgagaaaggattagtaaagcaggctagagttgggtatttctctttccccaggtcattaggttctgataaaatcctaatagtttaggtcatgtttaaaataaaagtttctcttgagagcagggcttgttaagaacagaatgctctgacatatttcaaaacggtttcttttcccctagccctgctgagggcacaaggggatttttctctaatactcactgtgagaacttggtggagctcctgtaaataaaacttacaaaaatgtgtggggtcctcattttttaactttcaaatggtccactgtaagcctccaacaattcatcaattacggtccaaagttttctacccggtttaggtttctgttccattaagttgtgattctctgtacctacgtgcatatctccaattttgggagcagtggtttgccctgcaaccttacttctctgagtatctaagaagagttgttgatttttcagtttttctagcttttattgttggagcatggactgacgacttctaagctttttcccttccagaccagaaatgtaacctttaaaaacaaaattgctaactttaggcatctttaaaagtgaatatgttttgtgatttagctttttgccatctatttcaacccttcctatctgaagttttgtattagtccactagaacaatttttagttgtcttgcttcttagcttatatcagtctttcttacttttagagcaatgagttatgtatttatgtgttattctgtgttgtttattcaacaaacaggtttttaatgagaccttcttaccttttgttgaactgatttgagaggttccaaagaattattttcaatttttagcaaaagtttcttagacaaatgctgtgtgtcagcaatggactagatgcaaagttacaaagaaaaataaaataaagtaacagtacaataaaaattcaaaattttattgaacagtccaggcacggtgactcacgcctgtaaacccagcactttgggagtctgaggcgggtggattacctgagatcaggagttcgagaccgccctggccaacatggtgaaaccctgtctctactaaaaatgcaaaaaattagctgggcatggtggcaggtgcctgtaatcccagctactcaggaggctgaggcaggagaattgcttgaacctgggaggcggaggttacagtgagccgagatcatgccattgcactccagcctgggcaacaagagtgaaactccatctcgaaaaaaataataataataataaaataaaataaaacaaaacttgttgaacatcataagaggtccctcagaagaccaccaaaataatgtaatatagtattgctgataagctcaggatgagagatagtaaatagtagattctcccaaggagggagccatcacttctcactgataaaatctaaccattattgaacaactgatatgccacttttggataagtatgtttttagtgattaaaaagtacctaaggaagtgaagaaatattttttctggttcttgtaagttgagaaaaactagttaggtaatgtttcatttagaaatgcagaatagacacaacatagaattccagagaagatcgaggtgatctcaggaagccttcatgacagagcacctaggatagaccttgagcaacggccaggattcggagaggagaatttggtgagcaaaggtctgacattgggatgagcgtggcataacttttaattaggtttgggtttgaaaagaaagaaaatatatcttattaatatttctggttccatgttgagaggccacagtggaatggtataaaaaaaaacaaagtttctcaatatgattttggttggtttcaagacagagaaaatatatattaatacaagctctatattcaccttcccaattagagtgtggtgtgtagaaaaggctgtaaaaataatttatcttgaacatgttctttagttgaataggtgatagtttcagctgttggaatccacaactacccttcttcaatcagttgatctgaagcagcattaaaatgttctgataagctcccttggaaggatagtaagccaacatttactaaacatttaaaaacactgcccttccaaggggattatggaagcatttttatgctctctgatagcaaataagtatactcaataccaaatagatgtttagcaaataagcattgatagctctgtctttgtttgtaattgtccttttgttagctaatttgagcaacaatgaaaggatatgtcatacaggtactttcctcattcaagcccactgcctacatgcaggatgcaggtcacaattctctgttcaggccagttcttcctttcaactaacttatgtttcatgaagttattttctaatttattgaaaagtagtttctctgcccacaatgaaagtactttattttcctctgtgctccttatacaatagtgtagaaagagcatccaggtatgaaatgtatataaacaaagaattagcattccatacttgagttttcatctcttccacctggagcaccattagatgttgatgctcttggaatgaacctgcttgcacactcaccagcagcctctcatcaataggagagggacaggattgaggtaccctctctgcaggcttgcctgtctacccaaaagggaagtggtaaccaaaaagaaagggtgtggcatttgtttttcattccaccctctcatcaccaaagtccttccgcaccatttgctaatgtggtatttccaaaattttatccctttatgattgttaaatggctttgtccctttaattttctatcctttgaagactaccagatgtctgtagtttgctgcatctgagaatatctgaaagagagcaaggtgggagggtaccatgatgctggacccttctgaaggccaatgggcagaggcaagtatgatagttaatattgtcaacttgattggattgaaggatgcaaagtattgttcctgggtatgtctgtgagggtgttgccaagggacattaacatttgagtcagtgaactgggagaggcagacccaccgtcaatgtgggtgggcaccatccaatcaactgctagcacggctgcaataaagcagacagaaaaaggtgggagaaacttacttgctgagtcttctggccttcatctttctcctgtgctggatgtttcctgcctttgaacatcagactccaagttcttcagcttttggactcttggacttacaagagtgatttgccagggacactctggcctttggccacagactaaaggctgcactatcagcttctctacttttgaggttttgggactcagactggcttccttgctcctcagcttgcagacagcctattgtgggacttcacattgtgatcatgtgagtcaattctcgtaataaactccccttcatatatacacctatcctattagttgtgtccctctagagaaccctgactaatacagcaagtgtcgctgcgtggtggaaaaatcgagccagcttgacttcactattaactattaaaatgctacatctagttagccttttgaacagagacaaaattccttccatatttaccaattcacatggtaattttactatttctaagatgtagataaaaatccttcaaaagccacaagatatagtttcagccttaagaatgtggcttcttccctctttctccttcttttctcttcatcacactcttcatcctctttctcttcttccttgccttccccccgctttctctttttcatcttcacacaataaatactagctgaatgatgagactaaagtagggatgtcaggaaagaccctgctgaaaactatttgagaatccatgaccagtggaataaggcttaaactcctgctatttgtaggattagaattggtagcaatggcacaaacaacaaaactagggctgatgaagatgggtgacataggagatacaatagattcctaaggctgccttaattcattttagcaaggattagatatacttaatagttcctttttatacaaccatttaattactttcctgagtagaggtatctgtatgtattatataatgtaaaatctttccaaattagaaaaaaataataaacagaaataaaaaggaaaggaaggagcattgtcctttagacaatattatttcatagtcagatcctaacataggttaacatttcaaatgacatctgcaaaatctctttctaaatctgcttccatcatagtgttaaatacttcacattagcaccatgtggagaaaaaggcagacatttttaaaattgtcgtcttattaactgatgtgagaaaatgtttctgaatctaatgaagtatgaattagttatatccttatattttccaggctgtgattattagtaccctagtgaaatgctgaaatcacatgtttgaaaatacagatacaaacatatttctgaagaaaataaataaaccaaatcaggcttgttactctggttcaataataaattcaaatatgaagaacaggaactcttaaatataaagattagaaagaaaggtactctcatgtcaaaatctcagttgttttatttggtaaaaaaaaaatagttgtttaatttggtaacaaattatttaggtcattgtttattcacacagtcttctattagcttctcacaaacaaatagaagaaggtgatactccttcctctgagaatctgtcattaatttggaaaggtcagacacaccagcataaaagagttaaaaaatggcaatgagatttgttggtggtgataactagttctgtgggtcaatttcatgacctaaaaaataaagggatggggagggatcctttaactcaataggctttattccatctcaaaagtgtatatcagtataaaaaggtggtttaataagaggaaaataaattgtataattttttcacatagctatcgagagtggacagctctgtaccaagaagtgcagcatggttctaaatgtcactgaatcaacttctccagataaatgcagagacctacaaatttgtgcataaaaggttgagctcagggcaacttgctcacctcacctcccatccatgcttttccctctgggtcaaggctcctccatgtccgtacgttaaggagaaacactcaaatggctcagtggcctgcaaatagggtgtgaggactccaaaaaatgtgattgcactgtttcaaggagtagcagccactcagtttgagtggactgctgatatacagaatttaggtccaatttttcctctaattttttaagagaaatgaaaaacttgaatttttatgtgaaatcttccaaaatgaccttctaaaataatatttcccttttgacaaccatcataacattttaaggaaacaacatatgaaccaaatgaaatatatctataagctatgggctatgggctggacatagactaaggacaccagtgtgttatatttgttccagtgattcagtgtgaactggagaagtgaggggaagccggtgatgtttactgcagggtttgagctactccttgaatgtgtgtgtgtgtgtgtgcgtgcacacatatgcacatatgcacataactaactgtgtacacacaaggatatatataactgggaaggtaaaaatggaggccaatatccagaccctggaaatatccatgatcaaatggctggaatgataggaaagtatggaaagtttggtcatcacagtagaatgttttcctggctagaggagacagaagattgagtttgttgtaaaacagagccttgaaaggcagatgaagatgtttgtgctagcagaaaattcttaaacaatcttaattaattacatgttgatcatatataaagatgtgtgtctcccaggataccggacataaaataatactaccaatgaaaacccaggactccatataatagattaaatgaattgtatcaagacccaacaaacaatgacactttcaaaaatatttcttcctcctcacttattatcaatcataaatatgaatttcaaatcttagttgatttcagtggcaaaaatgctggagttttgattatttgtatagtgatcctgatgtaaatttctccagtaggcaagacagaaaattagggttgagctgaatgtcaattattcatgctaatttccattcatgtacaaatatctgatgaaactcatataatgaagctgggtccattttcacctttagtgaaaagaaaatatcactgaaaggatttgaaactaggaactgaaaattcaaaattatctttttcttgaacactcgaggaactcaagattttcacattacttttgttttggtttcacttgttcggtcttttgtttgtgttttgttgttattgtttatttattattatttgtgtttgtttgttgatattatcttcttggaatgaaaattccaaactagagagaagggaatgctacaaaatttaaattttcctcccagcctttaaaccagggcatagttcacctctccagaggcagcagctgctatcagttctttggataaacttccagaaatattacatacatataagtatcacttagacactgaattaagcacataaaagagcccaaatagaagtcacttagaaggtatagatttgtttttctctcatgtcgaagaggtctggaggcaggcacaccaagctagtaaatatcagagactcaggcacttttaatctttctttgtcattattctcaggatgtagtttttatccttaaagtcacctcatgagcacaacataattgctagagtgaaatctatcacatcaatattccaggcaagaagaaggaagaacaaaaggatatcactcccagcagtcagctccctttaaagagctttcttgaaaatcccacatcacatctaattgtttagccttttaggcttaagcctaaagtaggttttaaggttttaagtaggttttaagctggatactttgcaagtcccaaatacaggggttctgttggtaaagaataaaggaagaagggatattgaataggcaactagcaacccacaatatagaagcctacacgtatatgtattctcttccttcacattttttaaacaaatggtagcttactaacacagtcacattgcttttaactctatcctccacattcattagatttcagtggtaccaaaaccaaaggccaaaggccagggctgattcctctaaaagataggctctgccctccttcagctgctcataataacaattgcttcctgcactccttgctatgcaaagaggagcagtcacaaaccagcaacatcactgttacctaaaagcttccagagtctactagaaatgcagaatctcagctcttctccaagtctactgaatcagaatttgtagtttaacaagatctcaggtagtgtggatgaggatttcagtttgagaagcagtatgcacatttagcccttctaaggttccagattagtgacagcaaagcttgagagtctgttaggagccttctcccaactagcttttggggtctggaagtaattccatatcctaggcggggtatctgtgagaaccctagagtaaaccagcaccagtttgagcatcaagctgtaaacttactaatctatttctgattgtgccagtagtcagaagttctggtccttcttccctaatgtcgtgggctgggtccttcctcctatccccactccctctctgcaaaacttgaaggaaagtagcattcaactccagctaactccctggttttatcttcccttttcttacggagctgtccttgcttccagtttccttgactcttctcaaatgagcctcacttgtttctaatcattaaaaccaaaaactctgagaatttatcaccatcctgaagcctagatcctggctttttttttctttttttgcttcattgagtcaggacaacgttgatgtctcagtcaatttgagctgctacaacacagcaccatagactgagtggcttaaacaacagaaatgtatttgtcgcagttctggaggacaggaagtccaagatcagggtgccagcatagtcaggctcgggtgagggcccccctcttgattcacagatggatgccttctgtctgtaacctcacatggtagggaagagagacaaaaggagaccaggctctctcctgtctcttcttattggggcactagtctcatcatgggggctccaccctcatgacctaattaccttccaaaagcatcacctcctaataccagcatgttaaggattagagtttgaacatgtacattctgaggggacacaagcattcagttcataacacttggctatttacagtagctaggctaagggctgagtttgacaccctctcaaagtctcttttagagtcagtcctgcctcccagatctcaggcagattttttccaccgtaagtttataccaagccttgagcgtccctgatggttctcttttacccaagggtaaaatcagcctaatgcccaaaagaccatgctgctaatgtcaaggtgtaacttgttgctttgtcccaccattttttaagtccactgttagcacagcaagaactgcttctaggtgctggggccaggctgaaatgcagaggttggttaagtggctctagctgggatggagataggcaagcttagcagaacctaataattgcagtctagttgggtcctaatgtcaacactatgtgaatttggatggataaaaaggccattagatttgacaaaatgtaggctatttacctttaagagagcaatctcagcagaaaagtagggccagaaggcagattgcaatgaattaagcaaggaatgaaaaacagaggagaagaggcagctgataacattcatttctgacatctgtgggtagaaggaagaagctataagatgtaacagaatcaaattatatttttgtaagataagggagaactacacatttttgaagcagaagggaaagagtctgtgcaaaggacatactggagacaaactcaatagagcaacagaaaaatctttgagagtaaagataatgaaggaacactgcagaggggttgtctaaagaggaggaacttctcatatatagtaagaaagaatgaaggaataaatgtagacacaaaatacaatcaggtgtgtctgcacattggttcacctaaatagtcttacactcaacaaagtaatagaacaggcaatgttttttattacattgaggactttcatagaatcaaagatttgtattgtaagaaaagcttatggaaacaaatctgttggtgtaatttttttttttcatttaaagagatgggaaaccatgaatgaaaaaaataaactgatttgccaagactggtttaaagtaatctagtggccttcaggacttgacactatctaaagagtcccaatggggacatagacactctaagagtaagccctaatgagttaacctcacttcacttttggacatagttactaggctatgctgggattcaagtgtgctatgatccaaggtgctatggtttgttttgtccctgccaaaactcatgttgaaatttgttcctcaatatggcaatactgggaggtgactcccagtggaaggtgtttgagtcagtggggcagatccctcatgaatagactaatgctctcctttgggagtaagtgacttctcactctcatggtaatggattagtttctgagagaacaggttgttagagtctggtttccttggtttcattctccctccatgcgatcgatttgcacatgccagcttccctctgctttctgacacaagttgacgcagcctaagacccccaccagatgcagatgcccaactctgaacattccagccatcagaattgtaagccaaattaatatattttctttataaactacctagtctcaggtattctgttatagcaacacaaaacaagccaagacacatgcacctcaaggtgcaaattcaagtgcacctgaatttcatcaaagcatttagcaatcaattacactccaaaaataatgaatctcctggaccaaaaccagatgcaagcaactgaagggaaatatcatgttaatatagttctggggcttttccaaagacatctcagaactcttagtttgggcaataagaaaatgggaatcaaaggaaaaaaatcattatatcaaaaagacacaagcatgcatatttttatcacagcataattcacaattgcaaagatatgaaaccaacctaagtgtccatcaactgaagagtggataaagaaaattaggtatattcgcaccagggaatactacccagccacaaaaaagaatgaaataatgtcttctgcagcaacttggatggaacttgagaccattattcaaagtaattcaggagtgaaaaaccaaatatcatgtgttctcacttataagtgggagctaagctatgggtacacgaagggatacagagtggtatagtggatattggagactcagaagggaggagggtggaaagaggataaggtgatttttaaaaaactacatattgtctcaaactatgaaactactacaagaaaacattaggaaaactccccaggacatcagtctgggcaaaaatttcttgaacaataccccgcaagcacaggcaaacaaagcaaaaatggacaaatgggatcacataaagttaaaaaccttctccatagcaaatgaaacaatcaacaaggtgaagagatgatgtacagaatgggagaaaacatttgcaaattacccctctgtcaaggggtactaactagaatatataaggagctcaagcaactctataggaaaaactccaattatccagttagaaaatgggcaaaagatctgaatagatatttcttaaaagaaaacatacaaacgggaaatagacatatgaaaaagtgttcaacatcattgatcatcagagaaatgcaaatcaaaactacagtggaatatcatctcaatccagttaaaatggcttatatccaaaagaatagtaataacaaatgctggcaagtatttggagaaaagggaacccttgtatactgttgatgggaatgtaaattagtacagcaactatggagaacagtttggaggtttctcaaaaaactgaaaagagagcttccatacaatccagcaatcgcactgctgggtaaatattcaaaagaaaggaaattggtatatcatagagatatctgcactgccatgtttgtttcagcactgtttacaataggcaaaatttggaagcaacataaatgtccatcaacaaatgaatggataaagaaaatgtggtacatatacacaatggagtactgttcagccataaaaaaagaatgagatcctgagatcttgtcatttgcaacaacatggatggaactggaggacattattctaagtgaaataagccaggcacagaaagacaaacatcatatgttctcacctatatgtgggatctaaaaatcaaactcatggagatagacagtagaaggatggttaccagaggctgggaagggtagcgggaggggttagaggagctggggatggttaataggtataaaaaaagaagttacaaagaatgaataagacctagtatttgatagcataacagggtgactatagtctataataacttaattgtacattttaaataactaaaacagtataatttggattgtttgtaacacaaaggataaaatgcttgaagggatggataccccattttacatgatgggattattatgcattccatgcctgtatcaaaacatctcatgtaccccacaaatacatacaccttcaatatacccacaaagagatataaaataatttttaaaattacatattgggtacaatgtacactactcaggtgacaggtacactaaaatttcagacttcactattatgcgattcatccatgtaaccaaaaccacttatacccctaaagctactgaaattaaaaaaaaaagaaataaagaaaatgggtaccattcatgaaaaaaagttctgatttctattgatttgaacatattattatgaaaaattgatggttgttgctcactgaattgaaaaagttacaataaggccaaacgtaaagtctaagaactctagattattagacacaagcatcctggagctatgttgttcttttgactcatatcttgtattcttgtgctgcagaaaaatgcttttaaaagcttaagccaccatttaaaaagtacatagcatatagtgagcaacgtgtggaggtggatagcacttaattctaagaaaggattactctgaagaattacaccatcatcctggggattacagtataaaagaccttgccactactttgctaagtaaatgcagctttggattgtgaaaggagaactgcatattgatcagcagtaagcagagaggttaacatcatgggctccaaagccagagtgtccctacctaagtggtttggggacatgttaattaaactctgtgcctcaattttctcatacatagaataaaatcaacaatacaacttagcacttggagatagaaggacttagtgaattaatgaacatacagtgttcaaaatagtatccaactaaaccctgtgctaagcactagatatccattatcttgataatcttcacaataattggtgaagtagtatgattatatctatttgacagattacaaactgaggctcagtgaggttaaataccttacccaaggctcactctaatagtagtggcaaaggtaaaagttaaactgagatctctctgaccacaaagatggactcttgaccaccataaccatcaactgtgaggtgagtgttggaacccaggaacaaggctgaaacccatcctgagacctgggtatatcagagcaacgctgttggcaagagtggcctcatgttgatcccccaactgtcagatggaaccccttgaatccctgccacccaagaacagtaatggtcctgagaatagaggtgaattatttccagcggtcaggagagaaaagacacaaaatctcagatccaaggaggatgtaggagcacaatacaggaaaagtggtgatactcagtgtccattttgccaagaccataggggaggcccagtagtcaatgacatgagatcctctcccacccttgatcatggagtggatggtctgtgatctgttgcagcaatgacggaggatgagcagatccttggttacacaatgggcttcactcaaaggtctatcagtaacaaaagatggtactgaactgggagcagtggtgtgggcctccaatatgagctacttcccacatgggaagctgaggcaggagggtcacttgagtccaggagttcaaggttagcctggaaaacacagcaaaacactctatcttaagaaaaaagaagagagagagagtgagaaagctgatactgtggccagtttctcacacataacaccctggggccttctcagagctgggcctacagcatcatcagcctaattttgactcttgtgcaaggcagtggaattaggtgtcatgcactccatctgctgattcagccatacatatcacagcatctgccacatttcactaggtaggacttttacgtacgtcccgcaagttaggaaggccatgaaacaccattcaattacagaaaagcaggattccctactacgaaacatcccctctcaacttccacagacacatatggatagaggaatgcctgtctttctcttacattctcctgagaactataaactccatatttctacatgtggctttatctgcatcgaggggctgaacagtctactgagtttaccatgactcactggatggcaggagcagcacctgcaacagaaagagctccagacattgccatttgtaaaaacataccctcaatggctccttattggctaagtcagctgctcagtgagaagcagacaggcagggggtggacatgtcagtctgtatgcccagagggtggtgcctgactgcctaagcatggggatcagagcacagctgctctgccatccactgcctcccagtggctgctctggggacctcagctctcaatgcatacaacctggagatgaacacctactgctgggttatgtggttctgtggaaatctgtatttgaggatccattggcacaaatatgcttcctgaaatactgagggtgccccaaaatgaaaggggcacaaaaagagtccaaatgctctagtaagccagaaaccagattcaaaatgagtggtaagaacaagggttttaagtagctagaggttgaagtcaatagctcaagatgggaatgtgggacagaggttgaataagcaagtctgaggtcagcctgaatagatacaggccaagagctcctgcccaagcccaacttttactccagtttcttgggtctgactgcatttaaatgatcaggcatggaggaggcagagctcagtgtaacctagataatttataagtccccatagccacaaagacatgtatactcaacccaacccaagaccttgcctgtcacattctgacaagacaaaaaccactctctatcctcaaaatatactcgtagtcatgtgacacatttatgaattctcttttagtttacattttggattgtaaacgggtaaatattagatggaacttttccttgatagaagtatttttcttcaaatgacctcataacactcagatataatgatcctatcaaactagccacataataccattgaagaattattgaatttggcaatgtacacttagaaaagtcctacatgaaatgatctacttaaataggcccctttacaaaaaaatcttaggcaatgttcttattccttaatgacttgctaccagaaatgcattatcttagaacaaggttctttgtgagtcagggtaacatcgatgtcctccatgatattgctgagctggtgtgtgcagagtgtctgcatcacagaagtatgtcactgaaagtcttatctttcttggtagaggccagcgaatcatttgtttttcattttgaaactgtctccacaagtgcttcccatacacataagggcagtaaatccccagagcttgaataaatgtgatgctgtttctgttgtgcatttttatggtcatcgtggagaaaacaacttatttccatattcattgattcatttggagtccagggtgccagtgggactcttagaagagtgaaccaaatttcttcacataatttcaggcttcacttggcataagacacttccatagaagatgcagctctaattctggattcctgaaggaacagtaggagcagcttgattaaaaacaaacagattaggtattactgggagtcacactctccccagagtgatccaaataaataagaggaccgtctctcctaagacttcttcccctgaggatcctaagagcctagacttctgttctgctgggcgcacaagatagcacagataggcctgggtgacagttgcactaaaaggccctctcgggagccatagaaaaagaaatgtggccacaaagcatggggagatgaaactgtccacctgctgcctcttcttcagtctcagagtttcttgataagccctctagaataaggaaggataaatatgctgcctgtattaatctgttctcacgctgctatgaagaaatacccaagactgggtaatttataaaggaaagtggtttaattgactcacagttcatcatggttggggcagactcaggaaacttacaatcatggcagaaggcaccttttcacagggtggcgggagagagaatgagtgccaagagaagggggaagtccctgataaaaccacaagatctcacgggaactcactcactatcatgagaatggcatgggggaaaccacccccatgattcaattatctctacctggtcccacctttgacacatggggattattacaattcaaggtgagatttgggtggggaaacagagccaaaccatattgctgtccaatccactgagggtgaacccttggacaaagctgagccctcaaccccttagaagatggacttgaaagtttcccaaattagtagccacatgttatgtatctggacattccgttgtttatcatcctgacttaggacaagagggtatgctgaattcaggcttgctatgagggttggaacactgcctgcctgatgaaaactgctgtatcagttcaacagggtgactggaaaagtcttatcctatcatattatttctctctccccagtgaaggaagcagtatgcattctgaaatatccatagcatttttgatatctttcaagtgtttggtttcatgtaaaatcaaccaaagttaacccataaatgaaaagactctactatcctttttctttccacatgtttatacttcatccatctgttgaagatggtattatataatcattggcttgttctcatctttagtgcatgatccacacaatatcaaagcaaggcagcaaaaatctggagaacttattgaatcatggcaataactctgatgcacacaagcagagctggagtttacagtggctgagcaacatggtgacccacaagggaacttcagaattgctaccatgctggagttctgaaattcatccactgtatttcagacaccctggttttcctcccttacctcactttgcaatgcaattcttctcatttattcattcagaagcatttgatgaaacattcttcttagcaggcagtgctaagtgttagaaatgcaaagttgaattgagaaaaagctctcatcctgaaagagcttcatagtagagacaaacatgtaaataagtataatcaccatgcgaaatgtgccttattcaaggagtatgatgatgtgtcaaagtagaggaagaagcagattctctccctgatggagctggggcaggactctcagaggacacgatctttgcatcaggtctctcggagggtagttcctgccttccaggacctacttagaagataacgaatggacacaatgctgtgatacaaagcagtaccttgaagctgccattacagatataagaacaaagtgcagagactgttcagactagagatggatcaactaaaaaaatcaaagaaagtgacatttacaactgggcttaaagaatgagagggtttgtgcatgcagagatgtgagaacagggtgagggggtcatgggaaagcaaagaatggggtgtactcagggagttggagtacagatgcatggcagaggagagtggaagataagccttggagccaggctgaagcaggatcataaagggactggaagtggatagcaagtgcatatgcatttgcaccagtgaaacaatctttgttactgagtacctacctcaaattgtgaataaagatttaagaagatgtgtattgccatcaaaattcaaacatgctataattgctataaaactcacctttaagaaaataaagaaacctcactgatttcatatttttctccagcgactatcctttttctcctcctctttcagtaaaactccttgaaagaactgttaatattctattttctcttgaacctgctctgatcggatttttgcccttctctccaccaaaatgaccataattaagaccactgatgtcttccactggtccagtccagtgttcaacgctcactcattgttcttaaccaatcagagacctttaacacagccaatagcctcaatttctgtacccctcatacttctctggtcagtcctttttggtctcttttgctggtttctagtcttctctccaattgctgaatgttgtgatgctccagaacttcatccatggaccccttctctgacttcactcacttccttagtcacatggctttaaataccatctacagatattctattaacctctacatgtgtcattgctctttacctgagaatttctcagcgttgtgctttcatcaagcaaccttcgtgcatgaggtaacttcttccccatctcacccccacagaaagtaggctggcttcaccttactgtgaaaacagcacagaatttccttccagtaacacaacccacaagtgtgcgagcatccatcaaggcccaagaggcatgataaatggagaaaagagatatgaaacttgtgttgccctctgcactgtgaataaaagtcctctgtttctgacccagcacccatggaacagtaatagactaatttgttaatttataagtagggtaaaatccctgcaaagtttctgacattaagtagctatgctttctcttagaagttacttaataccttaactgaaatacgttacatatagaagctttctattcacaaatgttcaacttaatgactttcattagaataaagctctgcacagagcagtgtgtcagtctctgtctgcctcccataggcagacttggtgaaggatttcagagagtcattttgaacttgaggataaaataactaacaagcagtattgtagaacctgtgtgatatggtttggctgtgtccccacccaaatctcatcttgaattgtagctccaataattctcacatgtcatgggagggacctgatgggagacaactgaatcatgggagtgggacttttccatgctgttcttgtgatagtgaataagtctcatgagatctgctggttttataaaggggagtttccctgcacatgatttcttgcatgccaccatgtaagacatgattttactcatcatttgccttctgccattattgtgaggcctccccagccatgtgcaactgtgagtcaattaaacctctttcctttataaattgcccagtattgggttgtatgtctttattagcagtgtgagaacagactaatacagtaaattggtgccaggagtggagtattgctgtaaagatacccaaagatgtataatcaactttgaaactaggtaacaggcagagagtggaacagttcgaagggctcagaagacaggaaggtgtgaaaaagtttggaactccctagagacttattgaataactttgttcaaaatgctgatagtgatatggacaatgaagtcctggttgagtagtctcagatagagatgaggaacttgttggaaagtaaaataaaggtgactcttgctatgtttagcaggtggcattttgcccctgccctagagatctgtagatctttgaacttgagagagataatttagggtatcagacggaagaaatttctaagcaacaaagcatttaagaggtgatttggtgctgctaagtattaatatattaatgtatttatgtattaataaagatatggtttggaattggaacttatgtttaaaagggaagcagagcattaaagttcagaaaatgtgcaggctgatgatgcaattcaaaagcaaaacccattttctgaggagaaattcaagctggctgcagaaatttgtatagaagccaaatgttaattgctggaacaatggggaaaatatctccagggcatttcagaggtcttcatggcagcgccccccataacaagctggtaggcctaggaggaaaaaatggtttcatgggctgggcccaggaccttgctgctttgtacagtccggagacttggtgccctgcatcccagttgtggctaaaaggggccaatgtacagctcaggctgttgtttcagagggtgcaagcccctagccttggcagcatacacgtggtattgggcttgcagaggcacagaaattaagaactgaggtttgagaacctccacctagatttcagaggatgtatggaaatacctggatgtccaggcagaggtgtgctgcaggagcacagccctcaaggagaatctctgctagtgcagtgcacaagggaaatgtgcagtgggaatccccacacagagtcaccactggggcaatgcctagtggagctgtgagatgagggccactgtccttcagaccccagaatggtagatccactgacagcttgtaccatggacctggaaaagccacagacactcattgccagtctatgaaagcagccaggatgggggtgataccctgcaaagccacagctgtgtagctgctcaagaccatgggaaccccctcccttgcatcagtgtgacccggatgtgagacatggagtcaaaggagatcattttggcgcttactgccctgctggattttggacttccaaggggcctgtagctcctttgtttggccagtttctcccatttgcaataggtgtatttacccaatgcctgtacccccattgtatcttggaagtaattaacatgcttttgattttacaggctcataggtggaagggacttgctttatctcagatgagactttggactctggatttttgagttaatgctgaaatgtgttaagactttgggggacagttgggaaggcatgattcattttgaaatgtgaggacatgagatttggtaggggccaggagtggaatgttatggtttggctgtgtccccacccaaatctcatcttgaattatagctcctataattcccacgtcatgggagggacccagtgggaggtagttgaatcttggctgtgggtttttcccatgctgttctcatgatagtgaataagtctcacaatatctgatggttttataaaggggagttcccctgcacacactctcttgcctcccaccatgtaagacatgacttttccccacctttgccttctgccatgattgtgaggcctcctcagccatggagctgtgagtccattaaacctctttcctttataaattacccagtcttaggtatgtctttattagaagcatgagaacagactaatataccatatataaaatagagaaacatctatcattccttaaggattcttttaagctttaaggcttcaatgttggtgtgaatgtggggaaacttaggagagtgactggggagttatgttgttcaaggattcttctgcctttcttcaagcccagcaatcctctcattgaatgcctctcttctctgagttccctggaggaccttttttaatccctctatttcacataacagtggtcactaaagacacatgatttcagggatgactcaattttttaattcattcttaataagattcacaactagcaggacacacagcaaatggttatcctcctagtacctacaggtgtgaaacctaatctagtcaattcttatacaaggcctgcaggtcaaaacaaaccaatcccacatacaaatcctatttgcaaaaactaatcaatctcttaacaaaaagtggagttagaatgtagctttatgtcatttgcattaattaaatatatcaaagaagatggaatgtatgctatcagaatttacaatatagagaagaaagtcattttaaattatataactacagaaatggatacctttagtgaaagacaaaagttgtctttaaaatgaatgactctttccaaattttattaaaagcagagataatcaagactgttgtgctgatgttatttactttgcctgtgtttgttattggcaagaatgcattttccatttcttgtagacaagcagaaagccacagagactatttaaattcaaattctgggaaatcaagaactacacaacagtcagccatctacaaattgatgatcaacatgatgtctagacagtttctcatgagggcaacattattaattaagcagcagtttggttaatcacaatagcaaaagtaatttttggagtaaatatttcatgagtatgcccatcaataaggcaaaagtaaaaggaaatgttttaattaattcatttataataatatagagattatggttggcaaattctgtttgaggacttgaagaatgatttaatatttctagtatggcatgtcattgtcttattgttttcagctaatggtactgtctatctccattgcctggccaaaaattctttcatgtcatctatcaagacaatattaaggtccattagtgaatagttagatctgacaaattttttcttgctatacattgttctgttcttttaaaactgtgcattcctacatttatcagtaagaaaatattcactggatagggagacataacatgcttccatgttaagaaactaaccttactttctgtccatcaaaagacttgttatttggaaaaggaaaaataaataaattgaccagttctctttagcacatagacaatgaatcttttcagaaaatgcagttaaaccaatatttttataataatccatggtcttaaaattataagaaagaaatataagttacatagaacttaagtaaacacatatttctgaaaaaattatccaaagagcttactctcttttgccttcataaaagttcatctataaccatcttcacatacatagcttgcttcatgtctcatcctactcccaaacctctctttgaatttcaactgtatttacttgaaggataaaatgaagactaaaaagcttgcatttatttttcaatgttagtcatctggtcaacatcttcatttttagcctagaagaaagtgtgcattaaaatcacataaaaatttcctgcaacaagtacaattttattttatattatacagatttcttagagggtatttagatttttatccttaaatatatgaatatgtataacaaaataatatatggttcaactactaacagttaatactttccagtcctcttacaacagtggaaagataatttagtagagggtggtatacacttagtttcaggtcaagattcttccatcgggacaggatttttttttttttcaagggaaattggtctcctgttggatttccaggctcaactccatcaaattaactctacatattgatatgtgaaaacaatgtatcagcatgactgagtttgttctcaagagacgttctcatcaatcctcaggcctttcttccagtaaatgccaatggatgaaccagtaaatgctgatggaccaaccaataaatgctgatggactccagcatgacaaattgaatgagccaatattagaaaacaccaaaatacgtatttcctgtcaaagaggctaacaatatgttaacgtatactttaggcatcattctcatattgaaaaacatcaaaaaagacaaaataataattcgctttaagtcaatataaaggtgtgggtagaagtattatattttttccaaaaaagagggaggcaatgtattagaacattagaaaataatattcgttgtggcattaagctatcatgaagactttagctttacactggaaaagtcccatagtactcaatcaaaacattttgatatatctttgcttacctctcacctatatgcatgaaaaaataatgatttgtgggatttaacttacctgagtttgttgtggaggaataatcattggaatacaaaaactatcaagcaactatgggcttacgatccaataagcaacttccaagatagaattcgcaatgcatcatctaaatttctgtctataggcaaaacaacagaactcctcgttcggaaattttccattgcagcctgattcctccattctgttactatccttctccttccttgcagtgacactgaaagaaaatccagagtgtcagtcattttagtcacagtttataggaagagactcttgatctgcctggctgctgcttggtctagctctttaggtttcaaaagaaatctggtttatccatgtttatgacactagaactcatgttgcccaaacttactgaactatttttcaagctaaaggatcatctttgaagtaagttctccaaagtaatgaattcaaagaggtatacaaagtaacaacagaaaatgcatgtatcaaaaggtgtacacaggataatccgtggaagcatgggaagttgcagcttctttttctatttattttttatctaaaaacctaaggaacattagcttgtaacaatatctgacttatagtttaacactggtagcctcactaggcccacatgccagaaggtcatatgtcacttaactacagggatacattctgagaaatgcggccttaggcgatttcatcattgtgtgaacatcatagagtttacttacacagaactaggtggtgtagctgactacacacctaggctacaaacctctatagcactgttactgtactgaatactataggcaattgtaacacaatggtaagtatttatgtatctaaatatatctaaatatagaagaagtacagtaaaaatatggtataacacataaaagttaataagcctgtatattgataagcacttaccataaatggagcttgcaggactggaagttgctctcggtaagttggtgagggagcgatgggtgaatgtgaaggcctaggatgttactccacactgctgtagactataaacactgtacacttaggctatactacatttaatttttaaatttactttcttcaataataaattcattttagcttactgtaacatttttactttataaaccttttaaagaaccttttgactcttaaaatatcacttagcttgtaacacaaacacatcgaccttctgcagctgtacaaaaatattttttctttacatccttatttataagcccttttctattaattttttttaactttttaaacttctttgttaaaaactaagatccagctgggtgcagtggctcacgcctctaatcccaacactttgggaggctgaggaggacggatcacctgaggtcgggagttcaagatcagcctgaccaacatagagaaaccccatctctactaaaaatacacaattcgccaggcatggtggtgcatgcctgtaatcccagcgactcgggaggctgaggcaggagaatcccctgaacccaggaggcagaggttttggtgagctgagattgcactattgcactccagcctgggcaacaagagcaaaactctgtctcaaaaaaaaaaggaaagaaaaaactgagatccaaacacacacattagcctcagcctaatcatcagtgtcactgggatcagtatcatcaatatcactgtcttctccatccacatcctctttcacgggaaggtgtttcaggggcaataacaggcatggagctgtcatctcctatgatctcctatgataacaatgccttctgaaacaccttctgaaggaactgcctgaggctgttttgcattgaacattttttttttttagatagaaggactacactctacagtaagaagtatagtataaatacataaaccagtagcatcattgtttactatcaatatcaagtattatatactatatgtatttgtgtttgctatacttttatatgattggcagcacagtaggtttgtttacaacagcattagcacaaatatgtgagtgttgcatgtgctctgatgtcacaacagctacaatgtcaataggaattttcagccccattataatttcataagaccaccattatttatgtggttcatcactgacggaaatgctgttatgcgatgcgtgactatgctagcagcaacctgtgtggagcaaaactccatactataatgcagttagcagtgacgatcgtgttgggtgtattgagatgaattacaatctctgtgcaggatttagtagatttacagattatattatctgtttttaagaaaactaatgttcacaaaatttcaagtggcaaagacgttatcttggaagaatccatgcattaaagataaaactaattatggacacaaatgaattattttaatagcagagttgacaggtgtcctcctcttagtacaagctccctgtcaagtacaatgcaaaataaaaacaacaatgatctaatcaaagtgaaaagacaatacccccagaatttgaaattgtcaagaaaactgtttgaaatgtgctatttaaaataattacgatctgtttatacacttttggtgggagagtaaattaggtcaaccgtcgtgaaaatcggcgtggcaattcctcaaagagcaaaaagcagaactaccatgaaacccagcaatcctgttactgggtatatacccaaaggaatataaatcactctattataaagagacatgcacgcctatgtttattgctgcactattctcaatagtaaaaacacggaatcaacccaaatacccatcaatgatagactggataaagaaattgtggtacatatactccatggaatactatgcaaccataaaaaataacgaaatcgtatcttttgtgggaaaatggatggagctggaggctattttccttagcaaactaatgcaggaacaggaaaccaaatatcacatgttctcacttataaatgagagctaaatgataagaacttatgaacacaaagaaagaaacaatagacactggggcctacttgagggtagaggatgggaggaagaagaggagcagaaaagataactattgggtactggacttaatacctgcgtgatgaaataatctgtacaacaaacccctggcacatgtttgcctatgtaacaagccttcacatgtacccccaaacctaaaataaaagttaaataaataaataaaataattatgttctgcttttaggatatatatttgtaggtaggataaaacatggactagatgtacaaacaccagattgatgatcgtagttttctccccaatatcaaaagatggcatttgctgacaagaatggattgctatgaactgtgacttgtcaaatattcctctcatcattttttaaaattaggatgtcataatcatacttcatacattaaaacttaagtaattttctttttttaagttttttgagcagttactgtaatctttttttttttttttttttgctattatactttaagtactgggatacatgtgcagaacatgcaggtttcttacataggtatgcatgtgccatggtggcttgctgcacccatcaacctgtcatttaggttttaagccccacatgcattaggtatttgtcctaatgctctccctctccttgcccccccacaggccctggtgtgtgatgttgccctccctgtctccatgtgttcccattgttcaactcccacttatgagtgagaacatgagatgtttggttttctgttcctgtgtaagacttaagcaattttctcagtgtcatttctccatctccactgtggcctaaattgtgcagaacctgctgcgagtctaaatatgagttcacagatgtgataggcagaataacagttccctaaagatttccacgtcctcatctctggaacctgtgaataaatcattgcacatggcaaacgagaatgaataaaggttgcagataaaattgattgataatcatgtgaccttaacatggaggaattgtcctaagttgtccaggtgtgtccagcatccttaacagtaggacaggaaggcaggggaggaaggaccagggagatggcagcctgagacagaatcagtagctaaggaacacaggcatcctctagtagctgaaaaaggcaaggaaacagagtttgccagatcttccaggagtacagccctgctgacaccttgattttagcctcgtaaggcccatttcagacacctggccttcagaactgtaagatttgtgttgttttaagtcactaagtttgcagcaatctcttacagcagcaaccgaaaactaatgcaagagagttcttgatttacatgtatgcatgcttgcaggtatacacatatacacacacacccctaagggagaacccaccaagaactagaaagttgtttgctggcaaaagccttctaacatatggtttagtaagaaaatgtcccgacgttatgaaaccatcactatcacaggccaacataaagaaacaaaaatttgcaacaaatacagcaaaggctttttcccccataagacctcatataaattaatgaaagcaagatcaagttaataaatgagcaaaaaacctctgaggtaattcacaaaataaaaaacataaatggctaataaaatatgaaaatacatcagatgaaaaagaactattgcaaaaataaataaatgaagagatgccattttgtttattttcttggcatgtatctttaagtggaactctcctatggtatggaaaagcaggcattgtcagtcactgctgtgataggatagatgatacaaactttccaaaaaccaataatgtgtaaaaaatagtcataaaaatattcaatggcacttctgaaataataattttacctctgggaatcagatcatcaaaaattcaggaaaagcattaatatttttcacaatattatttataacttgaaaacaactttcaataatagaacattaatacatagcagtatatttaaataatacaaatttatgtagtcattaataattaagcttatgaagagtattaacttgggtcataagagtataagtgatatatagcaactgcaagagagaaagattggagagaaatctattgtaaagttattagtgatgggattagggaccatttctttcttgtgtatgtaactggtttactgaatgggttggtagaatacagttgaaaggcaattttgtttgttctctcactgtcccttcaagtacacattacggctttgttcagtctcaccctttggatcatatttcaagcagaatttatagctcttttagctcctcagagatattaaatatctagtccaggttactgcaaattctcatccacttaaaaactctcccgctcagcttgggcctgatttcaacttgcagatttgcagagaggaaggaacacaacactgcttcctcctcttctcaccccacttctctcactgttcctctgcgttatcgtggggatgaagtagaaggagaaatgatgggagaaaaggaggaaacaaggtgttagcatgacgggttccattgtaatctggcagggatactctctgagtgtgacagctcccacacgctcatgcttcttcttgtggggtgcttttaggggttcttcagaatcccaccccacccccctttaggatccctacctgtttctcggatgatcagcctccctggtttgccactttgcacccctacttggcttctatagccaaagtaccaccatccttcttctgaggtcacctgccctaccaggaagtcctctgggatggctccaactccagaacagcacaggaagatctctccagaggccttacccccaggctaagggcacacacacacatcctgccctgccaattccacccagtcctgtctccacacactgtaaccaaaagcccctctagacacagcctcttgccttctgactcttccaagtgtgagttgggtgccaagccccatgcttcccaaaatgtaagaaatgttaagctccccaagtgctttcgcagcaccccctcacctggcttgaggtgagaggaggtgcccgctgggtgggaggaaccatcagcaccctggcagatttctctgtaagtccttctcctaagacctcaccctaaacttttccctaacctctcaccctctcagggcttcttggcctttgtccagacagtccagagatggatgacaagctcagggtcctaattcacatgggcagtcaaaagccccagatatcttgttctctgcattggaaactttagcctttgacaccaggactatcagaaaaagtttcttttcccggtattattttataatggggttaaagggtagaaacaaacgttaacaaagacaagaagataaactatagcagctatcaagtatctatttttcatacctattgaagtgcttatagtaagtatttttagactggactagattcatagacaattttgtcctctaggaactgcagtgtctttggctccatggaataaaaatcgtcctcttagcatcataaatgcagaggttaaattctactcctgcatttattctctgaattactagtatccaaagtacaaatcatctcttctgttttattttatcactactgaatcaccagcaagttaacgtgttttcttgtggtttgattaacaaagcaatttagtatccaaatatgatttacattcccagagcattttaaataattaagtagatgattggtatttaatttataagcaacatgttttgattccttctgtagcttttaaactttaaaatagttatagttaattagtgctagtacaaaatgctcaatcatcagaaaaaaatcaaaactttaaaatggatttcttaataatctttgctgattataaaatacaggaactgtaagtcccaaatcaaaatctaagtgaaatatctagaaactggtttcttcccccatttctgtgtactttttagaaagctattaaggctgcatagaaatgaaaaggctcttttaaaatcacagctatcattttaaaagagtttttccactgcaaactcttaaaagttgctcataaatatttatctttattagattatattggctctttaagtatggaaacttggcatagattcttaaggtacacattttttcccttttgcagttggtgggttttgtgtatgcctgttatgtgatcagtatttccatggaagaagaagacacatgtaagtactgttttctctctccctgtgggttccttttgaatgagatacagcttccaaaactaatcattacagggctatgaaatgaaatcttttatatttggagtctaaaatgattgaactcagcacactaaagttacagtcaaaagttgacagactgaattgcacacaaataaggtgacactacatatagaaacactcaatttgtgagagcacgtgcagagacttagaaggacaaggactgctgtcatatcatatattagcaacttttcatcagacacctaaccattatgccgagtagacagtcagcggttgttttacctattaccaattttaggcatgttggtggcagaattttgaagtctgagtaacagtaatgatatcaatacaataatacattacagaaagatctatatgtatataaaccatataaaatgcaatgaaaaaaactaaaatttacaaccttccagatgagatgcaaaaaaaaaaaaatttacgaggtgctaaaaaaaagttaatgggatgcttaaaagctaaatcatgttttaacagaacacccaaaggaaaaacatttattaatattatgacctgaagttatatgatagagctttagcaccataggtcaacaaatgactttcattgagtacctgctgatgtataagacacttcttggcacaactctgttagggactcacttttttttatttactttcaaaatttttttttttttttttttttttttttttttttttgagacggagtctccctctgtcgcccaggctggagtgcagtggcgtgatctcagctcactgcaagctccgcctcccaggttcacaccattctcctgcctcagcctcctgagtggctggaactacaggcacccgccaccatgtccggctaatttttttgtatttttagtagagaaggggtttcaccgtgttagccaggatggtctcgatctcctgacctcgtgatccacccgcctcggcctcccaaagtgctgggattacaggcgtcagccaccatgcccagcctactttcaaaattttaatttactttcaaaattttaatttactttcaaaaaataaattattttagataaagaaatcacacctaaccaaaccagagattgcattgcagtcattgtttgaatttgtaacaaaatgaagcaaagtagctagccattgtaacttccttccagaacacaacctcaaaggggtctgatgaacgcttcccatcaaacagatgagtggtgcatgatatatgagttggaatccagaatctgatggggtcttgtctcaatttatttgaccaaacctcagaccctgagattaaaagtatcaggcagtgaaagcatgcagacaaattgcatcatgtatttaatgcttacacagagtttttttttttttttaatgctagataagtcaaaaaatttctgtcacttgacaagtgcagttctaatgacaacacttttcattttgaggttaacttcaaatctctatttttaggagttttattagtagttctacaacctgatggagttaatatacagaaggttagcagcatgcttccaacccagagctaagacaggctgcacagccaaaaaacagttggttgagcatgaacaatattaactggaatttcaacctgaaagttattggaatttgagctgaataagtcaaaaaattaataaattgataagtcctagctgaatctcttacaaagtagatacctacttttgagtagttatcaaacaacaacaacatccaaaacaaacagtcctctttcttttcctcctcactaaactggtcaaagactctcaaaagacaccagtgctcagttgtacctaacagtgggagaaaaggcagattaatcaatagtcttattatgtagtgcaataaatatacaacagtcttttccttgagacttgtggtttaagcaaagctgggaaatgcaaaatggcatgtaaaataaaagactcatctaaatggatacttctgttaactttctattagccttcttttcagtgtatataaattgtattgttcactgccagatatcgtcgttccattgactttgatgtctttaattaacttaagtttctctatagaaatctctgaatcagctatttcagtgcccttcaaactgggattgaagcagctgctaggagactattctattagtggtttaattctagcatttgttattagggccatacattacattaccaagagacatctggatatagtacttgtattgtcatcaattcaaattgactcagagtcaaaacgaaacttgggtgctcaaagcaaagtatatatgccaaagactaacttaacatgataatctgctggaagagagatgataatggaaagcagtcacaaatatttgatagttctcaaatgagggtaattttatattttttattgaatgaggtaggaaacaaaagtgcagatgtaattaagttgtcccagggtcttcagaaggcagatgtgagcaaaaagtaatgtctgaagccaattgcaatgatctcatacactagtactatttgtgccaacacttagcttttaggtgcaaaaatgaactgccccttggatatgacattaccaaccctcagtgaggaagacatgtcctttgaattatttttccaaaacttacacataaaataagtaaacaatactggtatctttccaatttgtctaagtacacttctggaaatcttattctaaaagagatctgcaaatataatataatgtcagttttttggcaggcaatacatcattcataactttgattctattctaactaatgaaaatttctgcattattcaaaatgcaaagttaagccttgttcttgggctgaaaactgccagccagccttaaaaattaataacagctaccacttctctcctctgcactgttaaagtggatatatgggactaacatttcagacagatatttccgaagggtaataaatacttgaggaaacacttatttctagccacccgtcttcttagttacctctcagcctcttttattaactatttcttataaagattatgattgcaggtcaaagacaatgaaataaaaagctcacaaaaggcagagtgctaggtggggtcagagcttctcgtcattcattctaatgaaaaagcttagttatatctcttccttccatttttcattgcttttaaatatatatacataaatatatatcaatctccatgaacactttcatgagactagaatctctggaatcataatgatagaaatctgtcaacaccttgtttgggaatcatttgctgaaaatgaacttgaggatttgttactacttgttagactttccagaaataatgtttttaattcagagaagtgtggagataaggtgaaaaatagcattttacttgtatcaatactgccaggctttttcagagggtctgttgctagcactacttcttctgatattaggctgcaaattgcaactggcacatttatttgggctcacaaaggctagtctgggttgtatatgttgaatgatgagagacaaaagtatattgaaaaccctaacagtttttgaaaggaaatgaatccctcagatgtgggttcaatattttacattaaaaagctctaaatagttctttatataaacatttgacccttgctattatacttttgaggaactttttattggaaggaagcgtaactatcggaaaaacatttcatcgctctactgtcctgaagcttcctgctggctaatgttcatgtatttacctgtctgcccatgaactccttctaagaaaatgaggtgatatttccatagcattggtgtgagctgaaaactttttaaaatcctatctccacctaagaatttatgaaagaagcgaatgtggtaggaaaaaaaaagactagtttgaatgttaatttatgaatttccttttccaacttataatgtatggaagcctcagagaagtaaggtgaccacaaggccagacaccaggggagggaataagcagaggcctggaagatcttcagagtagaaaaccagtccattgttttgcacccctagcaatgtatgaacatttgaaggtgagagcagaggacagtgctgtgagtcaaacatggaaaaatgtgcaaaattggtaagggtgatcctgaagtcacagtgaacatttcaaaggagccaccacatttgcctaataagccattaagaatctactgattctcacagtgcatatatttttttttttttggtaactatctagttggttgcatgtaactgtcctaaaggctgattctctctccttcagtctcactagagctcagatttagatcctgaaacattttcctaatttgctgagatggctctgccaaatagctacacaatgactagctaatcctcccactagcaagatctatgaaggtagaatctttgttttgctccccactgtaaccctatagttcagaaaaatgccttgtatgtagaattcaataaagaaatatttgttggctgggtgtggtggctcaaccctataatctcagcactttgcaaggctgaagcaggcaaatcacttgagctcagcaattcaagggcagcctgggcaacacggtgagacctcatctctaccaaaaatacaaaaacatagccgggtgtggtggtgtgtgcctgtggtcccagctactcgggaggctcaggtgggagtatcacttgagcttgggatcggaagtgggagttggtgggatggaggttccaggtttcagtgagctgagatcctgccactgcactccagcctggctgacagagggagacgctgtctcaaaaaaaaaataagaaaaagaaatatttgttgagtttatagtgttaaataaattttctgggcccaacaactcagttttacaaagtcatttttaaaactccaaggttctcaagtttgatactgctttatatttagaatttagtgagatgtccgatgcacttgcaaatgtttatgtgaggcaagtggaggtcctacatttttaatgcaattagatatatttttagtaattttgaaaatcaaggtatagggagataaagtaaacatccactgtaccacgtcagaacaagagcttaattttgtaaactcctggacaagacactgctgagaaaacagggacttacttgaaagggatgcactcacagagtaaggcaggcatttaggagtcgactcatctgcaacatgtggtgaaggggacagagttactgtcaaagagtggggaccagcagggttgtaacctcggccaccccacacagaggaagttcaggcagcacagaacaggatcccagctacagtgctctggttgagtgacaagattccatcccttaaataggttactgagacagactctctctcaagaatatcataagcattcaaatgcccaaaccagcaaaccaactggagattccctacaggggaaagatagagaagcccctttaccagaaccagatccaaggttaccactaaactcacagtgaagtagagcctaaaagattgcctatctccttaagccaggattcctgattataattcagcctgactaagaatcatctacagcgatatatcctactctcctccctccccaacctccagccacatctgttttcctgaatccaccaagagctttcatacccaggcctttgagagaggcctcctccctctgttgacccactaacttatatacacccttcagatttcagcttagctgtctcttctgaaatttaaccatttttctcccaccctttccgggttagttgaagatacggatgatatattgtgagatgctttcactgcacactgtgctttttccttggcaacatttaacacaactgtaattttttaaagtcatattattcaccaaggctgaccccatttcctaacataaagggaaccctacactattttcaatgaataaatattaaatgaatgagtcaatgtatgaacaaatggactcagtaagatgattagggtttccaatggcagagatcggggagaaggttcttccttttctcctctctatctccatttatataaatgacagctcttcacatcagctgaaaagcttgggcatattccttgtattccctgactcttccctgattgtccacacccagttaatcatcaaatgaaacatcttcacctcctgtcttagttcttctgggctgctatatcagaataccatagactgggtagcttataataacaggaagttatttcacagagttctgttgtgaaaagtttaagatcaaggtaccagcagacttggtgtctggtgagggcccacttctctcttcataaatgactgtcttcttcctgtgttcccacatgggcaagcaagcaaggcagctctctgaggtctcttttataagggcactaacccatccatgagtgacctaatcacttcccaaagacttcacctactaacaccatcacgctggggattaggtttcaacatatgaattggtgggggtgggagggtaataaacattcagaccatagcatctcctttcaaataactaaaaactcctacatgttctttaacattcttctcacaaacaccctcttctccatgccgcagtagaccctgagtgtgtctctgaatctgcactcaacttactttttaattaattgcatcccccactcataaaaggtggagatcatatcttacctaccgtagaatctcagaacctgcttcagtgtatggaacatcataggaaatcagtgcatatttgttatacaaaatacatagtggagaaaatgcttgtctttacgttatctctcatatctctttcctcactccctaagaaaatttaaacttcccattccctgtaccacaggaaaaaaaatgattaattcataataaggtatttgtgcacttatatcttttatcaattttccagagcaaaagcatggccctatattatgcacttacattatctggaaattttctggagagaaggtgtagcttgttttgccaaaaacttgagaccagcaagcagacaactcctgcaccccagagggggttctaattttctgtgtttctacttgaaaccagatgttagaaatgatttcagtgatggtggtcctaactgccaatatctagctctgtgaccattgctgaatcacatcacctctttggggatccgcaagtcactgacagctctgacactgcagttctatagatgatgcttttgggtgggggtgatttcaacgtgtgatcaggcacgtcacatttccttcttcactgatttacaaatggtcaacatcaggagtggtttcaaaacaccctgacctctatgctccagagttacagtaacaaagtctgatgtatcagcctcagcactaaaacaggccctctacacgaatgcctgcccgctcagaaggaggaatcacatctccctactccctgctttagacaggtcagagctctccagttctcaccattaccaacagtgccaggctgtgcagcacttctcaagcactttacttgagaaggaagaatgaagaatctgccattcaggtggtgccgagtggaaaatgtgggatttgggatgcagatgtgataatgagggagcagagtaccaaatttaaaaatcacaccctcgtgacaccctggatgcacagcaaagaaaaaaatggactgtaaggatttcatgaggatcttgtgcaatagttttatcctggttattagtggtaaaatttaagagcccagcagaagagcagttgacagcatcttgccagggcctctgtgtttccattttaaatctaaattcagtattctaatcccaacaaccccccttctcaacggtctcacaaagctggctctgccagcccccctgtgggtttactgaacctccacttctgcacgtctgtccctaagctgcttagtggtgcagagaggagcacatagcctgatgcaacctcacaacgtcacatgtgagccgcccaacccgctccaggggcctcccactcattcttcatcactgctttctccaaggcccctaaaagtgaattatttgagctgtcagtgccgcagatcaccctagcctcattttagagaacttagagtttctatcctcattttggggatgaataattgaggcccaaagaggcaatgtgaccgccggcggctttttcctcctctgccctgcacccttagcattaagactccatcactgagactctgtcacacaaaaaaataaaagcagtgggaatgatttcctcaagttcccaggctctctatctgtcagatctgtctgtatccatctgtgatcatcatcttcctgacagaaaaagcagacttcattttgtcccgtggcttttgtggctgctatgtccatcccacccacctatttaagcaccttgctctcttaattattttttctctctgtcccctcccccaactttactccctctgcccagcttcttcctccactaggtcttttcccttcagcttataaacaaagtcacatcaaccagaaaaagaaaatagaaatcacccttgactccaactggcatgaatttaactttcctgtctgtcatactcctttcctccacatcccaacttctctcatactccttccctccacatcccagcttctctgcaaagtggccgagactgacagcactcccttcctcacccccctcccactcactctcatgcctcctgagttatcactgaagatgctgtctcagaggccagcagggacttcctaattgtcaagttctcttggatcttatcaagattgattgacagctttggctgctgttgacttctccttccttgaacactttctcccctggatttccagaaaatcgcatctcttgaacagcacatattttgccaattaaaaattatttttaatatctagtgttcaatagtagagtgactataatttacagtatctattgcactttgggaaatagctagatgagaatattttgaatgtttctaccgtaaagaaaagacaaatatttaagtgatgtatatcccaagtacactgatttgatctttgcaaattataggcatgtattaaattatcacatgtgcccccaaaactatgtacatctattatgcctcaatttttaaaggtactttaaatattcttacgcagattaagcagatttctgatgcagacacaggtaaccaattttgaacaacttgttcaagctgcttttggagtgatgagctgtcattatgtccttaaaatattaactaatcattcctactatagagtttatattaacattcacactgttatactaaagcattttcagtaaggtcagccaataaaacagaaatgtttttaaagtaagaccagacaataaaagagatgtttatccttttaaataacaaaatggcatataatatttttaagagctatagtcttggaccaattatttaagatttaatggagatctgattttacactaccttaaaaagaagtatcatacaagtaaccagcaataaagggcatatatggaacactcatcttcatgttctctagactatgtactttactaagaaaaaaataataatttagtgttctttctgggaacaatatttgaaactgccacctaaatgagatattagggagtattcatatgacttgaatgcaagtgtgaaaaaaaatagggaacatttggtaaaagcatttatctctccttctaaattgtataagacacaaagtaagttaattataaattatttctaagttataacaaactagtgtttccattttatccacatttttcctcatagaaggaaacagatctttctctttctctctctctccctctctctctttctcgctgattttaagtacagaaaatctatattaaagttagtggtattttctgaagacatctttctttgtcacagttcaatcaactacaaaactcctactgtttcccaacccttattcatttaataccaccttcagcgatatcatgacagctatgtacaagcttgtgtcagagactggctggctcttcactaagcccgtttgtttgttctcctcccaagcacacaattgtaccatctatcccagcctccaggcagttagatgccccatgagattgtattctagacgagggttccagtcctggcccccaaattacttccacgtgtgattcttcatgttcttatcctttcttcctgctggacatagaccagcactgaagctttggaagccgcacgtttcaaatgctggagccacagtatcaaacgggcctgggtcattgagtgttgctcagagaaaggttgaccatataatttgagaagcaggtgataagtgcctttgaggcataaggcactgaggagcacctgagagagtctgtcagagaaaggttccctcgcagacagggagaccccgagtagaaacaggcaggagttctcctgtcattcaagggagagttaggagtccagcgtatcaagcattcagcaaacagaagtgcctccagcatgcctgggaagctctctctgagaagaggacatgtaggctaacacctgaggatgaaaaggagctaagaggcaaaggccaggagaccattcctggcagaaggagcagtaagcatgcagggaatcacttactggaaagccttccagccaaaacaaagggcttgacttcagaagcagcttcataccaaatggtcgaagagatgatctgggcttccctgacctgctgactctcaaaaaagtagtgaattaaagggcagattgtcccagagactgcattgtaaatcccgtattgagcaggagggctctgtgaaaaggataaaaagtatactgtgttttcgtatgctgtgagaaaaaaatcacaggttgggcttaagttttattttcttttcctttgctctatatttgcctccttttctatttactcacccacgtgtttatttggaaaagtaaattaaatctgtttcttttttacttaaggaaaacaaacacttagttactagtcctaaagtcaaagccaaggtgtcatactgactgtgttttcctcctaactgagacaagaaagtttcagggaaacaggtgaagaccaaagtttctctatgactttgtacattttcatgagggaggcttttctgcccagaaaattctattaatatctactcagggttttaaaccattatgcaattttttaaagtaacaaattttttaaaaactgtggttttttgtttttttaagctctaaatcaagcttgtccaacccgcagcccatgggccacatgcagcccagggtgactttaaatgtggcccaacacaaatttgtaaactttcttaaaactttatgagattgttttgagatttttcttttagctcatcaactatcattagtgttagcttattttatgtgcggcccaagacaattcttccaatgtgtcccagggaagccaaaaaattagacaccactgctctagatgctacatagaactttaagtattctgcttataaatctagcaagtgttaagagtcactttaggggagagcttcttttcattgtgctaaaatacgtgacataatattaaccattttaatatttttaagtgtacaactcagtggcattaggtacattcagagtgttgtgcgaccatcactactatcatttccagaactttttcatcatcctaaacagtatctctgtacccattcaacaacaacttttcaacttttcatcctcccctccctccagcctctagtaacctccattctaccttttttttttggagacaaagtctcattcttgtcccccaggctggagtgtgatggtgcgatcttagctcactgcaacctccgcctctccggttcaaacaattctcctgcctcagcctcctgagtagctgggattacaggcgcctgacaccatgcccggctaatttttgtatttttagtagagatggggtttcaccatgttggccaggctggtctcgaactcctgaccacaggtgatccacccgcctcggcctcccaaagtgctgggattacaggcgtgagtcacagcgacctgccctctattctactttttatctctgtgcatttgtctattctaattacctcatgcaaatagaattacacaatatttgttcttttgtgtatggtttatttaatgtcccataaggttttcaagtttcatccatattgtagcatgtatcagaatttcatcctttttttttttttgagacggagtctcactctgtcacccaggctagagtgcagtggcgcgatctcggctcactgcatgctctgcctcccgggttcatgccattctcctgcctcagcctcccgagtagctgggactgcaggtgcccgccaccatgcctggctaattttgtttttgtatttttagtagagatggggtttcaccatgttagccaggatgatctcaatctccttacctcatgatcctcccaccttggcctcccaaagtgctgggattacaggcgtaagccaccacactgaaacttcagttactattcaatctgtttaaattcaatagtctacattcctttaaataatctgttccatttgtaacttaaattcccttaaacatttaacatgaattcattgtaattatcatttttggaagtccttcatatatttgtcccaataaacaaaacattcgctggtttttaagctaatccagcaaatctaataaatctaataaaataagctcattcataaattaaatctcaagtttttataacattacacaaatttaataaaatattgtcatgtctttcaacctaaaatcacaagtataaaatcaatcactcaattaaaattttgaattggtttcagtgggttaatctaacaaatctaatataatccatctgattattttaagaactaaaaagattttatataccaagcagacacagattatcccaatgattataaaattctaacctgtactttctgaaatagtattaacactatatgggattagcttactttgttttctctatagttaatttcatgtgttagaaatacacttctccaataaataagcatctcagacaacttaagatttctatatgttcaggaattttcggcagggaagcggtacccaaattctaagaagattctatagcttaccactaatgaatttaaagagcttttctttaatagttgttggaacaaaagaaaatctcattccataaaataatctagcaggccacagctacgggactcaaaggacattagatttgaatacagaagactttactcctactaagagtctcattttggttggtttaataattgttagccctttaaaacattttaacatcttttcatatggcttgacagacactttgttgatattccatttgcttcttttaatcatattacctgatggaatcctgtattctttccatattttaagtaggctgctaactcctgtacgcattgaaatgtttgattggctgtatttctctcatatcttttcttgttctgaggtcactaaactgttcatattcaaaagcatttatagtccagaggcaaaatattattgtttaattttagacttttaagtcccttaaatacttaaactgcaaacatgaattcactgtaatgattaatatcattttttagtccttaaaatattgtcctaataaacaaaacaagcataaataaacaaacttaaatagctaatttttcacttattaattgattcactcattcaagaagcaattattgggagacttctgtgagttaggccatgccacaaggatacagagattaataaaactcgatctgccagaagatcttacattctaataaggaagtgaggtaggcaaataattacagaagagtgaaatgcagatactggtttgtgtaaagtgagtcagatgtgcagaaaacgtaagcagaggctaactgtgtctcaaggcatcaaatgtggctgctcagaacatatagtatggtctcatgtgcaaaatacacatcatcaggaagagaacaaaggaaagacattttagataccagggaaaataagctataatagcacagaaacaccataaaatatttaggaatgtttgtggaaaatctggatcaatcaggaagtcataagttactgggtacattcagttcacgaaatgaatggtgaatcagtccttgagggaccttggattccattttacactagtgattttcaacctatttcatacttggcactcatggagaatgcctcttttttaaatttgtttttttagagacagggtctctctctgtcaccaatgctggagtgctgtggcacaatcatagctcatgcagcctcgaactcctgagctcaagtgattctcccacctcagcttcccaaagcactgggattacaagcacccggctggagaattccaacatttataggcatccagtggtagataaactagccatctccgaggaagaaatgtctgccctagaaggctaactaccccaagcctcactcaatgaacacacacacacacacacacacacacacacacaccagggaatgagagaattgataccttgtcacatctgtacccactcaggtcacaccacttcagatgctctgctggatgatgtggagcagtgaatggatttaatcttgggaatatgatcaaattcagttttctttgaacagcaattcatagaaagggaaaaggatttataaaagagatctcagtgagcaaatggcattttcatggagattgtcctaggaaagagagaaacaaaagtaataataggagctataaaaaaagaaagtatttcaaaacggaaatgtccaaaattgtgaaagcggacagtaaaaaggaattatgaagagacttcaatgccagcaagcatttgttacttgatttaaagagcaaagtaaaacattggctacacttaaataagaatgattaaaaaatatattgcgggaaaaaactggataactaagaaaaaatgtattacataggaaaagaatttgtctaaaactatttaggcaaactctcaggattgttttaagcctcttaccttttggaccatgattttttctctcagccattctattctgcttcattgactccaaagagtttagaaattcattatcctattatttaaatatcatacactattagaaaattttaaaatgggaaaaaattgtcagcactgagtatgagaaacatctaattccaaagatctggactcacagtgggagcaaaagccagaagtacagtcaaataaaaatgttgaatagctccaaaaatagaaaaggtaggtgttttcaagaattttttccaatcttattttctcctgaataaaaggttcctccaaatgagcccaacaatactgacacaaaggcctcagccaccagtgaaactgaacagacagtaattgaaaaattacaaaaactttgagagggacttcagtaaggccaaggcagtcactccatctaattactgagctcttgacaaagattaaggaatgattgagggcatatctactatagagaaagagagcacaatttgtgtgtctttaaaaagaactgagtgactcttaaaataagagaaaatgtactattaaagatactgataaagtcttgtgtggtgacacgcacctgtaatcccagcagtttgggaagccaaggtggaaagatctcttgaggccagaagcttgagaccagtctgggcgacatggtgagaccttctctctaaaaaaaaggaaagaaagaaaagtagcagggtgtgctggtgcttgctgcttggaaggctgaggtgggaggatctcttgggcctaggagattaaggctgcagtgagctgtgatgatgccactgcagtccagcctggacaacaaagcaggaccctgtctcttaaaaaaaaaaaatgcagactaaagtaagaaaaataacttattttttccaaatgtgagaaaatcaacacaaaaaagtttttatctgttaggggagggctggaatggtgagagctggtgtgttacagacatctttattaagacagtacaactcttgcaacaaaaagcaatgacagaagctgcagcagtagtaaatgcacccctgtaaggactctacagcctggttccctgactcaagaatcaaaaactaaatactaaagcaagcacagtccaggagatcctcacagaataaccagaataagcgtatcagtgaatctaaaggaataacactgaaaacaattggaaaaagccactttgagcaccttactcaaaggagatattattttcaaagactctctggagtgacttgaaatgacacgacaggagagagatcttatctcatggtttgtgctactggggaaaaaacggggtagaaaatgaaagcaatgccagtcaaaagctaaaggaaaggtgagcaggattgtcctgagcaccaggcattgacctgcccatggactattcagcagccctggagagggggaaggagagcacttccacatgacactcaaattcacaaattctgcctccacggagttttcttttctttcctaagagacctttatgcagacaagcttcctttccagaataaaaacaagtcatagaagataaaaccattattcctcaaaatgtggcacactaatgaattttcccttccaaactagctgttcattttaaatatgaagaaatccaaccaaacacaagtacaagttcgtgaaagttccacagggacacaacactgttcgggggacagcaaggacagaatgttggaattcttacagatcattatgtaatcctacattagacagagcctttgaaattttggaaataacagttaatgagagtgtatcctcaaaataagataaatgtttaaataagtcagcaacagcttgttgtttactgcatgctttctgtgtgctggcactccatcgccattaccttgtataaggtaatgacaccctgtgaggcagccattgtcctcattttacagatgagtaaactacaatttttttttcccaactcacatagcgtgtaagaactgcaattaatatttaatccagatattttgggtgccaaaatccaaatgcattccaaaatgcagtagtacctttctttccagaattttgttaacaataaagttcttaataaataggctaaaaaagatcgatatacatagagagaaagagagacgttagtcactcactagattaaaactagaatattcatatttaaatattgagtgataatacaaagtactggcacaatgtagggaaaataatggattagcccactaaaatttaagtggatatgaggaggcacatgtaaaagaacacactcaataatcttctctcaaatcaactgtctcagcacagactatttaatatgtgaagcttatcattagaaaaacagaatttcagaatccagttcaaatactgaaaaaatctaaaaacaaaaaaatttaaaaacaaaaactgtgtttcattttaatagctgcaaaattctatatggctatccagtgaaattatgaaatagaagaatacaccattgttaaagtctgacttgatacaatgtaagagaatatgacatgacagatgttgtgggtatgattttaaaaagcaaaaatgtaaccaccgctatttcccaaagaccggacttaatgcttcttcctcatggtagtggcttgcagaagaacttggccatcttcgtgatttcgcagctacatcaagtgcaagcacagggactgattctgaagtcagggttgatgtggtggtgtgggctgtgaggagtgggagtagacatccgcttcctttcccatctttcctgttggcatccactgagctgtgtaagtgacccactcccactgtggtctcagttgtcaagcatgtcctgctcttagctgtcagcactccgcatgtgaattacagtggagcctgggactccataccaacttcctgagcatcagaactgctgtttcacttgtcttccataatctcacaaatgtctatataaccaaccctaactcagaaccatatacagaaggaaattccaggacacataactccagcttagataaattaacaccatacaaaatcactacaatttttaataataaaaatgaaagcattactgttctgaaattatcccatggaatctaaatgctatagtgatttaatattcatcattatccatctttaatgtccctaaacaaactttagtagttacaattttaaaccattccatcttatttttggacattttctacattccacttcccccataaaattctgtcctaatgtcatatgtttattctgctaaaaatgttttcttaactcgttatatatttctgcagtaaaaaatcttgcagattgtaattccattctcaatgttatcttttcatgaacaaaagtttttaatttgtatagttcagttattaagcttaaagtaagaaattctgtggttagtactttttcatactttttaggactttgcctaaactatgtcccatgaagatattcttctatattatatcatattatattatatattaagcatcttacattgtgatctattgatttttacatatcatgtgaggtagaaatcaacattctttatttcctccatatgtgtattcagttgaccaaaaacccttcacataaaaaactattcttgaccacattgcaaagaaaatggcagacaggagacagaactaacttgcggctcccactcagatagacagaacagcatgtggagactcacatcatgaacttttgttccaagaactactgcaggaacatatcaggaaaactgaaagaattcgtagagcctttgaaagaagtggcttgccactgcgtactccgtgaaacagccgaaaactgtgagtgcccaaagtgtgagagggggaatgtctgtttccaaccacacatcctcactgggaaacttgaaaattcacatcacgggagaagaatttaaccttacctagagctgaaatgaatttagagagctgagtgaaatataaaagtagaagcagcagctggaagagccctgtaaggactcctcgcccccaaggaagaccagggaagctatttattactttatttcacaggggaccttggggagggctgccagcggaattggggaaaaactacgaggagaaagaaactccctactaaactttgtaataatttaaacataatgtgaattttcctggacagaatctgtagtgggggggcaaaagggaagtacagatacaaccacagaagcctcagcaggcagggaggggtgaagtctgaaagccatgcttgctttctcagcagggaggtttgtagcctggggcaagttctcagccttgcttactggttgcgtggaaataaatttggtgctattgggggtgacatagtgagagtgagactggcctttctggctgcatgagaactgactgaagcctatcattgccggctttctcccactaccctggcaacctgtatgacacagcagaggcagccataattcccctgggaacataactcccttggcctgagaaccacaactccataccccacagcagccatggaaaggcctgtccaaagagaggctgagctcagacacgcctaaccctgccaccacctaatggtctttctctacccaccctggtagccaaagacaaaagacataatatcttgggagctctaacggccctgccctcaacctgagaaagctgagtgctcctccaggtgaccgtaggggaagtttgtatcctccctatactactacagctgatgccgtcttgaaagcatcacctcctggctggaggctaaccaactcaaaccataaaagaacaactcataaaagaacatcactgccccaagaaaggagaaaacaacagctaatttcaccacctgtaacatcctggctaaccagaggtcctgagtctttccatgtgacaactttactgccagcacaaccagcattcaagaaaagcagtgcactaaacaaaaccataaccaaagtctcacacagagtccacttcactcccctgctaccttcactggagcagttgctagtaaccatggctaagtgacctgaagacagttcacaccataggactctttgcagacacaccccagtaccagcccagagcccggtagctctgctggatggctagacccaaagagaaataacaatcactgtagtcaggctcttaggaagccccacccctacgggaagaggggagagcaccacatcaaggcagcaccccatgaaacaaaagaatctgaacagcagaccttgagccccagatcttccctctgacatagtctacccaaatgagaaggaaccagaagaataattctggtaatatgacaaaacaaggttctttaacaccaccaaaagatcacactagctcaccagcaatggaccgaaaccaacaagaaatatctgtatgccagaaaaataattcagaaggtcgattattaggctgttcaaagaggcatcagagagaggtgaagtccaacttaaagaaattttttcaatgttactggatatggatggaaaaatctccagagaaatagaaagcacaaattttaaaacaatcacaatttctggaaatgaaggacacacttagagaaatgcaaaatacactgggaaatctcagcaataaaatcaaacaagtagaagaaagaacttcagagctcaaaaacaaggcttttgcattaatccaatctaacaaaaacaaagaaaaaaatcagaaaaaaatgagtaaagcctctacgaagtttgggattatgttaaacagccaaacgtaagaataattggtgttcctggggaagaggagaattctaaaagtttggaaaacacatttgagggaataagtgaggaaaacttttctggccttactacagatctagacatccaaatacaaaaaactcaaagaatgcccaggaaattcactgcagaaagataattgcctaggcacatagtcatcacgttatctaaagtcaacacaaaggaaagaatcttaagagctgtgaggcaaaagcatcaggtaacctataaaggaaaacctatcagattaagagcagatttctcagcagaaaccctacaagctagaaggaagtggggtcctatctttagcctccttaaacaaaacgattatcagccaagaattttgtatccaacaaaaccaagcttcataaatgaaaaaaaagatatagtcttttcagacaaaaaaatgctgagagaatttgccactacccagccagcactacaagaactgttcaaaggagctctacatcttgaaacaaaacctcaaaatacatcaaaatagaaacttctgaacacataaatctaacaggacctataaaacaataatacaatgaaaaaaaaagcaaggtattcaggcaacaactagcatgatgaatagaatagtaccttacatctcaatattaatgttgaatgtaaatggcttgaatgctccacttaaaagatacagaatggcagaatggataagaattcaccaaccaagtctcttctgtcttcaagaaattcgcctaacacataaggactcacataaacttaaggtaaagaggtgggaaaagatattccatgtaaatggacaccaaaagagagctggagtagctatttttatatcagacaaaacaaacttcaaagcaacaacagttaaaaaaaaaaaagacaaaaagggacattatattatgataaaaggactagtccaacaggaaaatattacaatcctaaatatatatgcatctaacacttgagctcccaaatttgtaaaataataactactagacctaagaaattagataggcagcaacacaataatggcaggggacttcaatactccatggacagcactaggcaggtgatatagacagaaagtcaacaaagaaacaatgaacttaaactataccctgggaacaaatgaacttaacagatatttactaaacattctaagtaacaactgcagaatagacattctattcataagcacatggaacattctccaaggtggaccataagatagcccacaaaaccagtctcaacaaatttatgaaaattgaaattatatcaagtactctctcagaccacagaggaataaaactggatatcaattgcaaaaggaaacctcaaaaccctgcaaatatatagaaattaaataatctgctcctgaataattgctgggtcaacaatgaaatcaagatggaaacttaaaaattgtttgaactgaacaataatagtaacacaacctatcaaagcctctgagatacagcaaaagcaattctaaaggaaaagttaaagcattaaatgcctacatcaaaaagtctcaaagagcacaaatagacaatctcaggtcacacctgaaggagctagagaaagaagaacaaaccgaatccaaaccctgcagaagaaataacaatgatcagagcagaaccaaatatattgaaaaaaaaaaatacaaaagataagtgaaacaaaaagctggttctttgaaagataaataagattgatggaccatttgcaatattaaccaagaaaagagagagaatccaaataagctcaattagaaacaaaatgagagatattacaaagaataacacagacaaagattattcaaggttactatgaacacatttatgtgtacaaactagaaaacctagagaagacggataaattcctggaaatatgcaaccctcctagattaaaccaggaagaaatagaaaccctgagcagaccaataacaagcagcaagattgaaatggtaatttttttaaaaaattaccaatagaaaagtccaggaccagatggattcatagctgaattctatcagacattcaaagaattggtaccaatactattgacactattccacaagacagagaaagaagaaattcttcctcaatcattctatgaagccactatcaccctaagaccaaaaccaggaaaggatacaacaacaataacaacaacaaaaactacagaccaatacccctgatgaacatagatgcaaaaatcctcaataaaatagtagctaaccaaatccaatagcatattaaaaagataatccaccataatcaagtgggtttcataccagggacacagggatggtttaacatatgcaagtcaataaatgtgatacaccacataaacagagttaattaaaaacacaaatcacatgatcgtatcgacagatgcagaaaaagcatttggcaaaatccagcatccttttatgattaaaactctcagcgaaattggcatagaagagacataccttaaggtcataaaagccatctatgacaaacccacagccaacactatacttactggggaaatgttgaaagcattccccatgagaactggaacaagacaaggatgcccactttcaccacttctattcaacacagtactggaagtcttagccagagcaatcagacaagagaaagaaatagagggcatccaaattagtaaagagaaagtcaaactgtcactgtttaccattgatatgatcatatacctagaaaagcctacagactaatccaaaaagaacctagaactgataaataaattcagtaaagtttcaggatacaaaattaatatacacaaatcagtagcagtgctgtacaccaacagcaacaaagctgtgaatcaaataagaactcaatccttttacaatagctgcaatatatatatatatatacacatatatatacacacatatatatacacatatatatacatatatatacacatatatatacatatatatatacacatatatatacatatatatatacacatatatatatacacacaatacttgacaatatacctaaccaaggaggtgaaagacctctacaaggaaaactgcaaaacattgctgaaagaaattatagatggcacagatggaaacaccccatgctcatggatgcatagaatcaatattgtgaaatgaccatacttccaaaagcaatctacaaattcaatgcaattcccatcacaataccatcatcattcttcacagaactaaaaaaaaaaaaaaaatcctaaaattcatgtggaaccaaaaaagagcccacatagccaagtcagactaagcaaaaagaacaaatctggaggcatcacattacctgacttcaaactatgctacaaggctatagtcactgaagcagcatggtactgatataaaaataggcacatagaccaatggaacaaaatagagaacacagaaacaaagccaaatacttacagccaactgatcttcgacaaagcaaacaaaaacattaagtggagaaaagacaccctattcgacaaatggtgctgggataatcggcaactcacatgtagaagaatgaaactggatcctcatctttcgccttatatgtataaaaagaaactcaagatgaatcaaagaattaaatccaagacctgaaaccatagaaattctagaggataatattggaaaaacccttctagacattggcttaggcaaagacttcattaccaagaacctaaaagcaagtgcaacaaaaactatgataaatagataggacttaattaaactaaaaagtttcttcacagcaaaagaaataattagcagagtaagcagacaacccacagagttggagaaaatctttgcgaattatgcatctgacaaacgactaatatccaatatctacaagaaactcaaactaatccgcaggaaaaaaacaaacaaacaatcccatcagaaagtgacctaagacatgaataggcaattctaaaaagaagatacgcaaattgtgaacaaacatatgaaaaaatgctcaacctcactgattatcagggaaatgcaaatcaaaactacaatgtgataccaccttactcttgcaagaatggtcataatttaaaaatcaaaaaagaatagatgttggcatggatgtggtgaaaagggaacacttttatactgctggtggaaatgtaaactagtacaaccactacggaaaaaaatgtgaagattccttaaagaagcaaaaatagatctgccatttgatccagcaatcccactactgggtatctacccagaggaaaagtcattatacgaaaaagacacttgcacgtgcatgtttatagcagcacaactcacaattgcaaaaatatggagccagcccaaatgcccatcagtcaacaagtgcataaagaaaatgtggcatatatttatatgtgtgtgtgtgtatatatataaagaaaattttttaaaatgtatatatttatatatttatatttatatgatatattatattatatatggtataatatatttttatttttatatggtatataaatatatatatatacaccatggactattactcagccattagagggaacaaaataactggataaaattggagattattattctaagtgaagtaactcaggaatggaaaaccaaacattgtatgttttcacttataaatgggagctaagctatgaggactcaaaggcataagaatgacataatggactttggggaatagggggaagggtgggagtgggtgagggataaacgactacacattgggcacagtgtatactgcttgggtgatgggtgcaccaaaatctcagaaatcatcactaaagaacttacccatgtaaccaaacgccacctgttctccaaaaacccattgaaacatatatatataactattatttccctgttgtcctatgatggcacctttttcataaatcaagtagatctattttctaactctattatgtttcatttatctattgtcctttcttatgtaatggcatactctgttaattactgtaatttacttgaaaaaaagtcttgatatctggtagtataagttcttcaacttggttcttcttcaagattgtcttaactaatcttgagtctttgccttttcacatacattttagaaatcagcatttttattaaactgctgaaatttttattgggctttctttgaattcatagattaattgctccacagatcaattggtagtttataatattgagtttcacaatccattaatgctttatattcttccattcatttagacatatttaatttctctcaattacattttactgaattcagtgtagtggcttgcaaatcttttcagatttattctccccaaaaaatgaattttccctgtaaactggaaatttttaagtgtttaatttctgctttggatgggaatataatttcaattattggccatcaacatgattgagtaaacataaattcaatataaatcttgatgagtaagtcctaatcataaaatgaaatatttgttggaaaagcacctcttaatgaaatgaatgcagcagttttgtttcaatcagttcatgtcttcatggatgaatattagttattgctagaatgataggctacctcaaatacttccaatatttggtgctagtatttatttatagaaaccttgttcacagaaaaaatacaagaatgggaagaaatttgctataacaatgtcactcaattttttaaaattccttccttccccaagtattttttaagacctgctttgtactagacactgttccaggtttgggggctatagcagggagcaaaacatataagagcagacaaaaatttttcccttataaagtttaacttgtaatgagggagtctgataacaaatgaattttttaagtaaaatatacaatatagcatagtaaatagtgataagtataaaagagaaaaaagtaaagcagggaaggagatagaacatgtgcagaaggttgatctgtagataaagaggctgagatatgtgcccaaaaatacataatgacctatcatctaaagttatttttaaactactactactagctgatgaggttcttcttcaattgttttggaagcaaaagattgaaagccagctacctttttattagtagctattactttattaacatcagcatacaaaattaaaactatcactttgtttggtgacccgcaggcttgttctgccaggatgatgcaccaagttaaggttccagatggctgagataaatgcctgtccttgcaaactggaaagaagatgattatagaagggaatgagagaagcaaggtccagaatggccatactttttcaaaggcacataaattttggaattgagtctcttgaaattgaacactctacatgcctacacaccatttaggaggtcttacattcacttggggcacaccttctccagtttgaagaccactggtctcttattgccgcccttctcactccccacaatgaggaagaatgaggatccgagacagagttggggagacttccagaccctccagactcttggggattgccctcagtgtttgtcaaaacaagttgccctcaaggacaattgaactatatcagttcttcacataagtacctgagactgagggggacaggacagagtgggaagcatccattttgcatagtattgctgagcagaaagaagtaaaaaatgttggtaaactctgatatggacaatgcaggctcttggactgcatactctattcttccagttggaactggcttaacattgagcatttcattggtcccatgtgcttctcttcaatttcacatgccttctgaaaggtggaggagattttaaacttcctgaagcataaagaaaacaaccataaatagtgataaagctggcacttgggcatcatctccctgcttggacatctcttcgggatcacaaagttatttcaggaagggggtagcacagccccaaccacccccgggacataagcaacggtttaaggcactgtcaagtccactgtgcccagcagacccatcatggtgccttggtggccactaggtatgccataagcagccccaactgtggcctgtgttttggcacagcaggccgtgcctactgaatgctcagattcttcagacaggagacagcaacagatcagtgacactgcagagtagctcattctctcgtaacagcagcagggtttagttgccagctacctctgaaataactagtctctcctaaaagccttcattatggtggggtgctgcgaactcctctctgcagtctttgaagggcctctctgtgtgaactaagttgatgtcaagcctcttccccagctttatccttatgaatttatatcacggaacaagaaaatcacagtgtaatagcccccatatttgagttcttcaaatgtttctttaagatgttattgctggacttggcaacttgtaaaataaatgctgattagaaaagcctaatacctacatagcaggaacaatgatggaacagaaagcaagctcagaataaatgtgttaagtgcctctcagcttcctgagtcttttcttttctctgacctaaacacaatgttataggggatctgtgctcctaaactcagtgacgaggcagtgtgcaatatagctggaacaaaacaaaacgcctacgttctggttaattatttgctgaatatagttaaacctgggacataaatgacagcttgagctcactggaaatggcaggttttcactttaagtgtatcaaaggcaaaggcaaaagtctcaatctgaggctcttaacctggagtctataaatgcaatgggctgtgaaccccatgaaataaagtcatttaatggatatagaagtgtgcactttcttacaaaggggttcctcaagttttataagattataaaagaggtctgtgatcctaaagataataagaatgatgactaaatattctcaaaatcttataattattaaccccttcccctccttcactgaggcagcaaacacttgctcagtgcctaggacttccgcactcccgtgacatctgctttggggaaacaaacatgaattaaagttctagtgaagaagaagaattaaattgatatatttgagctccttccaagggctggcaaggcactgtcctgtatataatatacatttttcttgtcaatcttcatagtaaacccattggaagttactattagtgttagccattgtagaagaatttaatttctaataatggtcacaacagtatttcctgtctaacttccccatcaagaagtggggagttgctgttcttgcctcttaagcccaggctggatgggcagctgtcctgactaatcaagtttggtggaagtggctctgagtgacttttcaggccagatcatagaaggcgacacagcttctgcctggctatatttggttgctagcccttgaactcatctaccattttgcaaggaagctcaggccacatgtagagccccttgtggagagcaacaaggtctccagccctcagccccagctaagcaaacagccaacagcctgtcttgacttgcctgccatgtgaatgcaccacctcagaagctgctcctgcagcctcccgtgccccagctaacattgcatggagcaaaaataaacctttcctgctaggctctgctcagacgtgccaatacatgagcaaaacaaatggtgattattgttttaagacactgttatgtggttgggtgctatatagcaatagataactagagcaagcagcttgcccatatgagcaactgccgcttagaggttaaataatttgcccacagttacacaactagtaagtgtagagctggaattcaaaacaagatctgcctgatacataaaatcaagtcaagaggatgaaagagagagttttacctatatctgtgacttggtatttccttttttttttttctttttttgagacagagtctctcactctgtcgcccaggctggagtgcagtggggtgatctcggatcactgcaacctcctcctcgagggttcaagcaattttcctgcctcagcctcccgagtagctgagattacaggcacgcgccaccacgcccagttaatttttgtatttttagtatagatggtgtttcaccatgttggccaggatggtctccatctcttgacatcatgatctgcctgcctcggcctcccaaagtgctgggattacaggcgtgagccaccgcacctggccagtatttcttaaaataaaaagaaatttgaagaaaatatagcaaaaaatatttatcttaaagtggaaacacaggcatctattattttatattctacatttttctgtgtattaaaagtgttttacaactttaaagtatcttttcaaagatgaaagcaaagtccttatcaaatttcaaaatatgtttaagatcagacatgaaaaataagttaaactttaaattgtgttaagttgccatatttataaaaccagaggcattactaatgtaatgtctagatgataaaagaagatcttgcttcaatttgcccagttccaacctctctttcttcatctaacggtgttaattcacgtcttcgtgccaatgttctgagcttttagctcagcagaatcttgaaaaatccaaagagatatgcataaacgtacaggaaaatagactccagtccacagaggaggatccaagtatctattctggatttaccataagcagcaagcatttccataagagaagggaaacattagcacttagactgcctctgaggagcacagtaaatttctcagagctgagggtgactctccccatagcccctggagggctacatcttcaacttcatgtgacatgtagtgaattatttctcataggaagctgccaggttgaaagccagccaccttgcacatgttgtctcctgaacagcagcacgagacgaaggagagtcaattgccttgagttcccctttgattctgcataaagtcaatcaggtttgccatggctgagtggggacctgaatcagtagcactgaattatctaatggaaacttcatttgtgtgtcccataaacaaatagaaaagttgctattggttgtgtatttttttacaagtagaatacaagtctgtatttgcacagtcagatgctgctataaatctaaagtagctctgtaattccttcagttctgtgagaatccttgtcaggaattggtggtggctagagcgagtaaccacaaagatattctgttacaagtaatattatttcttccaagaagttgctcggctgtgctcctggaagttggcacaggaagaagatttgaaaggactgcaaaagggtttcctggctgcaggctctctccaggggatctttgatggtaacacctcaggttctgagaatgggtgtagagagcagcccactgtgtggctggcttttctggatagttgatgccaacccttaattgtgttgctttttttttttctaaaatatatttttcacttccaggatctaataatcaaagtacatggaactcaatttcactgtactgcaggctcccagcaagctgtgccctgatgcttccttcagttgctccatctcttctgctcaatagtgttcttgctgttataactacagatttccttggatgtttttattccaaccttccttttctaatacttttgaaaacctgtccataccttttctatttcttttcgtgtttcattgaaattcacaccctgatttccactgaagaaagtacttaattcagcatcttctcttctcttatctttctcaaaaaagtgaatttaaaaatgcagttgctttactttcttatcagtgtaatatgactgcctttccccaaacataattaaaaactgaaggtctttcctaatgagttatttttaagtcttttgttaagtgttctatttcttaattttcttcattttttaaagcacttgatgtcattttaaaaaagctttaagaatctgtaaactcgccctctgtgtacactttaatttgcccctttacttgagctctcatcccactctagcaaatggaaggtattgatgcatgcatgacaaactgttttttaatatgaaaacatcctcaccttgaggacttggtggcttctgtggccaaaaagactcattgctctatcccatccatgaagaattcttgatatttcagtttctttattacttacttttcaaagattcctccttaatagttaaattttttgtagtcttgtctagttctagaatcttgataatttaagttttacctatatgtgatatattatttctagagtttacaacatttacatcatgctaggtttctgatatgcagagaaggtatagccaaaaaacaagtaacagtttaaaaagaaagaagaaaacaaatagcaatttaaaaaaaaagaaaagaaaaaacacatagaaggtgtggctgatttatagtgccatcaactgcaggaaccagatgtcctaatttggttaaaacagtccttgcttacacaagttgccctggcactttatctggtttagactttgtcctacattttttagttttcaaatgaaatattactattaatagttgtattaggcaaatctagaatggccacgtagacaactctttccatttctaccatagtcttatcaaggtatgcgagatgcatgagcaataaacagaatcctttttttttttttttttttttttttagaattctcttttaactgtatggttaaatctgtaagaaaaccaacaataccactctcttttctccaaaacttaaaagacacaatataactagcaccttcctttcaagggcagtatgcaacctggtcactgataaagatatgtacttggataggagtagtggagatggctaacaccttccagtctcaggtgggtgtgtgagaggcactgaaatctacagctcctaccagcacctcttcccaccatatccagctggtagggtcagtggagagcacctggaagtgtaagttaatgcactgacacattaggagaagaagaatttctcagagttaaaataatgatatcagtcttatataccagtttataatactggaattacattagtttatcaaatgctttcaacagaacaccaattaaattatttaaataattttaattttttaatccagttcatagaattagcataagccttttaaatttgtttgtttgtttgctttgttttgcggaaaggatctgagtttgtttcccaagctggagtgcagtggcacaatctgggctcactgcaacctctgcctctgccctgtgggctcaaactatccttccacttcagcttcccaagtaactgggactacaggcacatgccaccacgtccagctaatttttgaatttttttttaatggggacggtgtttccccattgttgcccagctggcctcaaactcctgagcccaagcaattcacccaccttggcctcccaaagtgctggaattacaggcataagccactgcacctggcttagcataagcctttattttatttcattttttatttattttatttttattatttttggaaacagagtctccctctgtcacccagactggagtgcagtggcatgatctcagctcactgcaacctccatctcccaggttctagcaattctcctgcctcagcctccgagtagctgggattagaggtgtgtgccaccatgcccagctaattttttaatttttaatagggacagggtttcaccatgttggccaggctggtctcaaacccctgacttcaaataatcttcccaacttggcatcccaaattgctagcaatataggcatgaaccaccatgcccagcaagcataagccttttagatgttcattctgtccaaggtaaaactctgatattattttaaatcctgtcataatctaattaagtagtaaatattaaagataaatatatttattttgtggaaataatacaatacaatttttgtgaagtacaacatatgggttaaaaaaaacaaaaaatattcttactaagttaaaaaatacatgaagcagaactgtatttggaattcaagtgcacaggaaacttacaactgcatcctaataaagccacactattttaccaatgaaaacagaaattcaaagtgttttcaaaatctatatatttagagtaaataaaatagaatatttttgtgatgaggctaatgttgaaaacaaaaagaaattcatcatgaaagaatgtacattttctctcttcccttcccttcatcaatctgagttctgactatttcgacctttgaagaactgctttgtaaatcaacctaagtttcttacaatgtctgtgagtatttttataaatgaatcttctacattttagttgcgttacattcaagatcaattgaaaaacttaaattgattattcaacaaaccaaagcacctccaaaaaaactttcaaaactcttcataaattgcaataattgaaaggttacagaaaacattgacatatctcctcacaaaagcaaaggaagacaaatgagaactcaaaatgttgcacaagaattgattttttaattttataatttccctttgagatatcttgacttgagaaaagacattttagaatggagccccagtttttaattggaaaactgtattttctgcaccagaaggaatagaagttgatttgagaagtcttacaattttgtagtgtctatatttggtgaaaagaatcataaatagatactatttatgggttttgtcttatgaattttttgccaaaaaaatgctactctgtatggaggcaaaattacagtatctgggaaaatatttgggctaaaatatactacacatatcctccatttagcaaacttgcttggcatttacacacaaacacacacacacacactcctgagagttcagttttcctacatgcctgtatgcctgttaatgttagagtgctataatgcaaccaaagcttggtttaaagtaattagtatctttaatggactatgaaacaggagaaacaaacatcatacgtgtacattagaattgggagaagaaaagattgaggctttgatcaaaaccaaaagaaactggaaagaatattacaaaaatgagaagtctatacagacagccagttactctgccattagggaggaaacaaaatctttgcaaaaggcagatgccgatttttggggagtggcttggggacagaaggcattggagatagattgtgtggcttctcaaatgcctttctaatgatgcaatacatattcttaaggaaaaaaaaggattctagcagcaagaggagacagtatatcttttgatatatagggagaaagggcatgtctgtatgcctaaggacaaacacattatttaaaatctcatgctatttaatattacttcattttttactgaaaccaataacaacttatttttcagaccctatgaatccaggttatttctgtattttttaaatttcctctttttggctcattgacaatatttttagtagtcctttttactaaacattttttcattttatggtgaacggatatttttgttaactttgctcttatgcattctattttaaacattagtattatgtgtattttttacacacttattcatatggcctatgttatattttcagttgatttcataggtggacttgatacacactcctactaccaggatcatgttgagttaaagcctgttaaaccagtaagtaaaggtgtgatgatatggaaaatattaatccttctaactcagccaaaactaaccaaaagtgaaataatttgaacctactactactaatcattggtttaattttccactcatatttaaaacacacctttcacatgtaacccaacatcatcattattattattcattccaaaaaggatttgaagctggtgacatgatttatatttcaaaaacaatagttctgtcttattccccttatcaatagttggtaactacattttttaatgagattatttaatctgcagaagtaaagaatgaatatgtgtcctggggcagcacagcaaagtaaaaaggggagaaagacctgcagtgaatccaggtcctccatgtgacatccaggtgccttcctcagtgtctctgagacttgttctatcaccatactatggtttcacaggggggaaatagattaaattggataatgtgtgtatgatatatgtaaagctgcctattactcttcccagtactcaaacatttgactaacaagttcaggaacaagttttctatgttcttagaggacatgaaaggaagtcagcaacaacaaaaccacctaaaactggtgagatttcagttgagtaaaagaaagaaatcttaagtcacctaattaataaaatactaggaaacatggaaatagatagggtgactccattcctagaaaattccaagtagcacatataaaactgtataaattaataatagctatcatacactaaccactttgcatatattatctcactaaatcttcatgaaaacactgcaatgtgctaattaatattcccactttataaataagaaaactgaggttcatagaggttaggcaactttctcaaagtcccactattagtaagttgtggagctgagatctttcctgggtagcaaaccatcacccaacctgatatgatggacttgctcagatgatctttttttctttcagctcagtgttctgtaatttgatggcgatagaagaaattatgtaaaatagtcgcttgtataataaacacatatgaaaagtttcacctgctgcctctttgccacagtggttcttacccaaatatgcagctccctcacccagcatatgtgaggattgaagatctgagaaggctacactgattcctctacctccccaggttgaattaactttattctggcagaatgatctaaagtaaacatagctcacaggaaacacaaatcagcactgtgcctgtcacatgatagatgtttaaataaattttggtttcttaaagcaaatccaatttggaaagaacattcaccctatataacactccagaaccaagcagtcaccacctcattactcatatcactaagtgctcataaaggatatgttccaaaagttgatgtttgtagatatggggaacttgtcagggattgtgacaataatcaagatgattagtgcattgggagtgagaaaagaactaagacaatgcctagtggtgacttaaagagtcttcatatatttgttatgtgataagaggatgatgaagggtttctttcatctccactgtgaaaaaaaaaactcagcagagaaattgcaatatgaaaaatgctgcaatttaagagagatccttctattagggaaagttattaaaaactccatttgataaatgttgataatgaaattttcttcttgaatgatttgcaaaaacttgacgcccatgtacctatgtacctcaaaagggtgttctgtggcatggcccagaggcaagtgacttccacttatgttctctaaagtcacttccatctctgtgaatcaaaaacacccaaaacatacttttaagatcacctaaaaggctttgatcaactccactgtctgctccaagggttttctcagcacccctgttcactgctgacctagcagtggatagctgaatatagcataaactacaagctattctctacagaaagcaatagaacaagcttctgctttgacagattatgcatattatcatgtcagatgaatatggaatgcctttcaaccatgaaggaagcaaaaatctaaaaatcaaactaagactgaattgaaatcattgtgcatgaaacaatttaagaggtcagtatctgtactcttcaccagtatgcaaatatttcagcatttatccagtctgcctctgtcaatctacttgatttcttttaataagcccgttatattgaattccattgaatccaatgatgccatatcactacccagcaacagcttggagaaaaagccaaccttctgtgcgaaattgttagagaggggaatgaatgctggctttgactttcattaagcctcttttatcacagtgaagtagaaagccaggttttgtgaggaagccactttaataaggggatcagaagaatccttagcatattcccaggtacatgtatgtgaacaggtagctttgaactccatatgcagagtttccagccaacagctcattcctaggtaatactgcagaattgtacaggaagccttaattctcatgtttgagtgtgtcactgctcataaccacaaagtgcacctttcaagtgtccacagtcaaattgtatgggaatgtgtataggggaagtggggttgggataggggtaaggtggttcacatatggatttggtctctcatgttttgtttctttctttttaaagtaatgatatcaagctaaaaaaaagcccactgattacatcaatcagtttaattcactttactatcactgattgattgcctacactgtgcacaacaggcacagcctaagtgctagagatataaagataaatgatacttgagatttgacccttagcagccaatgatctaggaggggagatctacatagaaagggtagatgcaaaacaatatttatccccaaggaaattttatgcgggagggggaatggttaactctcgcttagcgaggaaaggcttccctgagaaataacaattgagctactttgaaaagatgacacaatttatcaaaagcagaataaatataactatattggaagatactttggcagtttcttacaaaactaagcatacttttaccatgagatctagcaatcgagctccttggtatttacccaaagaagctaaaaagttttgttcacacaaaaacttacacaccgatatttatagcagccttttttttttttaagacggagtcttgctctttcacccagtggggagtgcagtggcactatctcggctcactgcaagctccgcctcctgagttcacgccattctcctgcctcagcctcctgagtagctgggactataggcgcccgccaccacgcctggctaatttttttgtatttttagtagagacggggtttcaccgtgttagccaggttggtctcgatctcctgaccttgtgatccgcccccttcggcctcccaaagtgttgggattacaggcgtgagccaccgcgcccggcctatagcagctttattcataattaccaaaacttgataaagaacaaagatgtcctccgtaggtgaatggatgaactctgggacatccataccatggattatttaatgctaaaaagaaatgagctatggcatcatgaaatgacatggaggagcattaaatgcatgttatgaaatgaaggaagtcaaactgaaaaggctacatgctatataattccaattatatggctttttgggaaaggcaaaactatggagacagtacacagatcaagggttgcgggaggggagacacgaataggcaaagacagaggatttttagaacagtagaactactctgtatgacattggaatgatggacatatttcagcatacatttgtccaaacccatggaatgtacaacaccaagagtgaatcctaatgtaaacgataggcttcgagtgactatatcagtgtagattcatcaattgtaacacatgtaacacactggtagggaatgctgataatggaaaaggctgtgtgagggcaggaacaggggcagggagcatttgggaaatctctgtaccttcctctcaattttgctgtgaacctaaaactgctcttaaaatattaagtctttaaggggaaaaaaaagcagcacaagaaaacgggtatccccagcatggaggctgattggcttggccgttctacagaagacaaagttgaagctcatgactccctaatctcatgtttgccatagttctcgtataaagtgagtgaacggataggaagcagaggcttaagcagagcaggtgtcttgacagctctcggtgaggaccctaagagacctgcagcagccagggctccaccattatgcctaaagctatcgagatgctttcagtggtggttatctgggtctggcctggggacatgtgatacacaggtcaggagtcatccgtgttgggtttcaatatcttaccacaactgctatcgagggaggtataagtctcaccataactgccatggagtctccaccgggatctactccatcaccacccccactcactgacagcaccaccaatgaaaggaaagagtaaagactgctcttatcatcagaacccagaacccagtggtcagcagcagtggctctgaaaaggatacctacacatcagcttacagtaggggcagcagtaacaccaggagaagagggttagcaaaagcagatttacccctcaggaagaaaaatagcatggcataaacatatacagctatcaaagagatatggaatttcagagaacaacatagtgagcaactaaattgaagtttgtcaaaatcatgactggtgtatttccatccaaatggttagcaactgagtaccgggaagattaagctccatgtagcagtaattcttcacataaaaataattagagcaaggcagtttatcaaagaaggacagcagctggaattccagaactgacttctacagcaaaggtagagctagatctgattatgttagaaatttccatgaggatgatgcctatgactgcagttaagaaagacttgatgagaaaagctgacctgagattcccccataactttcagcaaatctttttctaaggcttccaaaggaaaacttgttttctttggtatcttaacttgtctgattgcctttgctggaggctaatttttcttcacaaaaattgctacatgctaggtggccactgctgattgagtggctgctattgcaactaggtactagaagacagccaaggccaatccctatttcagggtagccctgcagcgagctctgcaggtactttcactgcctgctttctgtctctgacaatccgggtacacaggaaacccacctctgatgatcaggctgtaggacagatgcagaggtggtcacgtctctctgcactttcctgagaacagctgttttgcattagtacccctatatgtaagttgatgtcaggccattttgcatttatagcatcaacattaagtaccagctagtaggacaaatcagggtgtgtgtgtgtgtgtgtgtgtgtgtgtgtgtgtgtaggagttgggaaggtggagtaatgtgctttcaaaccttgatttaaaaaccagcaatcaccagccatgtgttagtaaactgcagctggaggcacctaaagaggaatagaataactctgtcttgatactgttttcatttgtccttaattagccttcacatcttatatttatccagatagagcacgcactgagctatgtcaaattctgcatgctgtttctcttctgtggcatgtgactataaggtgactgtgatccgctcctatcagtggctgtctcactgttcccactactaagggtggagccccgttccctgaggcttaccatcagtccctggaaatggaaaggacttcatgaggcgttaactttcctgggctgtctcaagagcactgcagctgtaaagcactcagcaccttcttagttgtcccgaaggagagatgggcttccttgtgtgcctgccttacttagcaccaatgcagtggcactcaggactcgttgctttctctagctttggacctctttccctttgtcactgacattaataactttttgatgcatcataagaatggttgtaccatgtcatggactactgtaagaacacatcctgatatatacttatttgactatgtagcagtgaaatggctgtgtgtatatagcttacgcagttcagacttatcaccgtagtatccagttagtgcacctctgtttttattaggacggaatgatgccaagagtgcaactggcaacatgcaagagggtttgctgtgaccagtggccagtcacgtgtcaaaggaaacacagatcatttcctttgacatgtgacttcactctctgcccctaaaatttgtggagcctgattctcatgcttccttgtgaagcacataaagcctttttccaaaatcagaaagcccatatctgaacagtgtcctccagggagaatatcaattcctgactttctcagaactttgctgggtatttgccattgatttcaatggcaagaaaatagatttatgcagtgatgtggagatatagtccaccaccacccctgaaaaaaaaaatcaacaacataaaaaaagtcattttgccctgtttccaagagaaagtatcctctgattttaaaattaaagccaatgatataaaccaaattttatgttaaatacacatattttgcacttaatattgacatcaaaaaaatttataatccccatattatgataagttctgggaagaaacaatatacaggaaagattacacaatacgcaggaaaaaagcacacacacacacacacacacaagtgattagaaaagcaatagaaaaagaaacatttacagttctatcagaagaaacacttgattccattctgccttgagggcagttacccttaagtaactactaacatatctacaaacgtctgcaaacagagagagagaaaaagagaaagaaagagggagatgatctcaaggatccccaaaatcgaagtattctatgcagacccattgatcaatcatagcatcattaaaagtgggacaaccaggccgggcatggtggctcatgcctgtaatcccagcactctgggagaccgaggcgggcagatcacttgaggtcaggagttcgacaccagcctgggcaacatgatgaagccttgtctccaccaaaaaataaaaaaattagccaggagttgtagtgcgtgactgtagtcccagctacttggaaggctgaggcaggagaaccacttgaacccggaggcagaggtttcagtgagccgagatagtgccactgcactccagcctaggtgacagagtgagactctgtctcaaaaaaaaaaaaaaagtgggtcaacgagacattttgtgtccacagatgtgctacaataagaagtgcacagcaccacctatagaatgccttgccataaagtcaagcctgaccttggactgatactatagaaatacaagaatagttaaatctcaccacaaggaagcaatcagccaaatctagcatgtgagaaatagtataaagcaaataaaaaaagaagaagaagaagaaaggaagggaaactgttattgatttaaagagacacaatagtcaaacacattgtgtatatgtggtttgcttggttttaaaactttttttaaaacagaactagattatatttcaaaacacaacttctgtataaccaaaaaataaaacaccacaataaaatgaatgagaaaaaaacatatttgcaattcttgacaaaatgttaacatctttagtcataaatgaactcttcagaaatcagtactaacagactcacattacaagggaagtgaaaacaaaaggaaaagaggaaaatggaatagcacaaatgagttataaggctatatgatcttcatcttgatatggttaacattactagatgagaaagaaatttcattataaattacattatcgatgcttacaaatattgatatctgatgtttgtacagctttaggaaatgaagaattctcaaatactggggcaagttactctagtcatggggagtttacccaaaaatgtagatttttgcataaatttggcccaggcagttctcaacgataggaatcactccaacaaatagttggatacacacccacacacatgcacatacatgtttactacatagaaaatgtgtaagtaatctattatcccccaagaaactacttatgtatccactggtttatgaaataatagactgggggtagaaatagaaagaaaaaagacacttaagtaaaaatactacatttcacaaaattctgtgtcctttgaattcttatgaaagatttttaattaatcagttttatatttaccttgttattagtgaaaattataaatatatgcacttcatagtgatgctgccagacatataaggcataatttcaacaaaccaattgtaatgagatatttccagatgattggagcaagtgattatgggctgagtattaaatgatattaagaaatttttgtcaattttgataggtatgctaatgaataggtaaaaagaagaaaagaaattcttaccaattgagcaggttctttcaacctctacacttttgactttggacaaggtaattctttgcagtgggtctgtgccactgtgggatatttaacagcattgttggcctgtaccgcctagatgccagtaacaccattccctaccaaactgtgacaaccactactgtctccagatactggcaagtgtcgactggttaagaatcactgagttagagacgcatggagatatgaatgaaaggatataatagttgagatttgattttaaatactctagccaaaaaaggctgtggggggtgctagttgataggtgaaactttaatagcataacttttattttagttgaagctgagtgatgaatgcgtagagattcataatactattctgtctatctttgtgtctgaatttttttttttgagatggagtttcgctcttgttgcccaggctggagtgcaatggcatgacctcagctcactgcaacgtccacctcccaggttcaagggattctcctgcctcagcctccctagtagctgggattacaggtgcctgctaccacgcctggctaatttttggtatttttagtagagacggggtttcaccattttggtcaggctgctctcaaactcctgacctcgggtgatccaccagactcagcctcccaaagtgctgaggttacaggcgtgagccactgtgcccaaccctgtttgattttttaaaattcaatctgttaataaaacctaacacaggtttgccaataggttttcctttgaatgccctctttcagagttgcctcactgtcttctgcaaaaactccccacagacatgtttcccagctcctgaagtaacacttccagaattcctacctgacatcataagaacaggctcagcctgtttcactgcttcaccaatccatgttgctaaagcccagaagcagaaaatattagctagaggcagagctggtgttaaagataaatgtaatggatacctacaagttcccccaaaccctcactgacactactgctaacaaagaaaaacaccttctcctgttgccttatcctcactcttgaagggattcatgtattggatggataaataaaccttgaaaattccttctaacgtaaagattgcataaagctataaaattccaccattataatcccatccctttctcttttagtttaaatccctgttaacatgccaaggagtagaaagggtagacattgagattcagaatgtagagaatagatgagcagaggaaatgtgatggggcacagggagaggcctggaggattcccactcctggggcgtgcaggagggagttgttctctagatgagttctaggcgcttgggtgggtatttttttagtcgttttcttcatgctgtacagcgagaagagtggcaaccaaaaagtaaaacttttgggaaatttttcagccattccaaattataaccaaagagttcactccaaggcacaaagtcatcaaactgaagtagaggaaaagaagttgctagatgtggttatgaagtgagtgtgaaacgcagtctgttggaatgatgcttataatttagttgaaggaagaaaacttgcatgcctgggtaaagtaattaatcatgaggcctggatgccaccagctgacatggggaagagctgatagcctgagagttgctcttagcaggatgagaaagcaaaatggctgagggagaactggaagtcttcttcacagtagagaagaaatttcagccaacattcaaagttgagtagggtttggattagctaagacttttcataggagagaaactgtgagagcaaaagtgttcaacagatgtttatgaagtatcatctatgtagtaggtactgtgttgaggttgacattgtgcaaagatgcagaaactgatgccctaacattccaaaggcttacagcttaggatagaataagtagagtcattgtcaaaagtgtggagaaaacagtgattggagatggggatctgtatgagtcagggttctccagagaaacagaaccagtagagaaagagagagagagagagtgtgtgtgtgtgtgtgtgtgtgtgtgtgtgtgtgtgtgtgcttccccacacatgcgtgcatctgggggctggcagactggagacccaaggaagagatgcagctcaagtccaaagacagtctggaggcagactttcttctaactcaagagacctcagtcctttctcttaaggccttataccgattgcatgaggcccacccacattacagacggcaatctgctttactcaaagtctactgatttacgtgttaatcacttttcaaaataaaaaatttaaaaaaaaacacctttacagcgagaggtaaactgaagttttaccaaacatctggacaccatggcctggccatgctgacacataaaagtagccatcacaggatgggatgtgtgtaaggaacataagtcaatgattgggtgttatgaaagcaagagcaggatgatcttgagcacttaactacccagcatactgtagaaagaacaggctatgtgaatatctcatagtttgcgcacacaacactaccctgttatctttacccttaagaaaagcaatagtgactactccatatcacacaacaattactgtgtggttggcacttctctcccaggaaatcatcctgaactctgatgatgatgcccgattaccatgccctaatctgaaaagcaggaaggcccaagtctttaactttcttattgctacagtcagacagcaccaggtgcacccaggagctattttgcatttcaaaaggcctcaatgaatataaaagatatttagctgtcagctttgaagttcttgaaagcaattcgtattttctgttttaggtcgaaataagtaatgacattgaaccagaaatgcggctgctgaacttgacttagggagcaaaggaccattgactgcgcgcctcggtggatccgacccgcctgacattccttccagaggctagactgtgcttcctggctttcccacgaatcatggagcattttggtcacagcctttgtattattagcattgttctctagatgagttctaggtgcttgggtgggtatttttttagtcgttttcttcttatatgaacacttgtaagttgtaaaaaaaaaaaaaaaagaaaaaacagaatttggttttaaatttttaacaatatttaatgtgaggcatgcaaaatgaaaaagcaaatctgtgaaaaccttctacagtcaattctaagagaaatctcagtgtgtgctgtggagatgttaagtcagcactgctgactgttgaagttattctaggcctgatgaatttgttttagcagacattacctgtggttatcagccaccaaggtagaccctgtgacagctgataaataggtacaaataatggatccagcttttggattgaatatgggtcattttttcaacagcataaaacaaaacatggagtcctcctttgttcctgacttcttaaaacccagaacgatattatggcaatctaaattttcagattcgtgcatatcttgtttttcctgatatatatatatatgtaggcacatggaagagtaaaaggattagtagaacccctttcccctttggagggaatatgggtgtctctgaggtccatattttctactcattattccattcctgacactgctgtcagacctaaacatacagctcatgggcttgtgggacagaaatcacaaacatagacctgcagtcaggaacttttctcttaggatattcaaaagaagcctgaaaatgctgtagcattctctataaatacttctaaaggagacattcacgtgtgagcaacatcagcttttctttctcctaccccttcccaataaccaagaaaatgatatgggaagcaattatctgtggaaaaaaggactgtcttgaaaacgcatcacagttgtatttttttaactggcataaaacttacatatggtaaaatgcacaaatattaatggtacgatttgattagttttgaaaaatgtacatacccatgtaaccaaggcctcaatcaaaatgcagaacatttccgtcactttaaaaaattcccttatgccctctttcaggcaatgcctacattctcacagacaaccactgtgctaattttcatcatcactgataatttggtctgttctcaatataaaatatatacacttttcacatcacttttgcccacacttctcaatcactattttttatatgaaaataagttttgctcactttgtgtaacgaccacagtgaagctccctataggccagaaagttgtgaatatgtggttattaactcagcccatgcatctctaagaagtccgtctattaaccacctaaaactgttacaaatatttgtatgtgtgtgaaagtcttttttcttcttgttcttctttcggagcctataggtttcatgagactctgttaagaatcagagtttaatgtgacaaagtttgccttcattcctccaagctcatcacaaccacagtgagccatttggagacctaatttactcactagcctccagattttacccctttaatccattggtacccacaaactcccattacttttttttctgcttaataaatccaaattcaaataaagaaaagctggcagggaccttgaagatggtggaatccaagccactattctgcagatgagggggctgaagcctaagggatttggtgaacttgtccagagcctgtatctgtacacaggggcaagagccatagccagtggacagagaacatgggagcaaaagttggggtttgggtcccatccaccaccatgttcttggacagtgtttgccatctctgcactacagttttcctcatcaatgaagtggaactatgatccctacctcccaaaggtgaggtgagaatttaacgaaaaatgtaaaaaaattctcagtacacagtgaagcactccacaattaaaggaggtgattattattaataatgtcaaaacactcctctgtaccctgtctggagctcttgctttccactcaagcgctatgaagagcccacagaaacaacaaactctgttttttaaaaagcagctgggaaaaccttgcccaagtttaaatgatttgaaataaactaaaaaatgctttaatttaaaaataacattaatattcaagttccaaaactaatgccaataattattgttagtattgttacgattattgaaaaagctgataaaacatcaaaactgtagagagtcagtaaaaaaggataaaatgagtattgacatattttaaactgtcacttaattacccccacacatacacatgcaaataaaatgtggttaacatttcacaaaatagaaccatactaaattttgtttctattttatcttcacgtgaatttgtacatagttctagtaggcactgcagagtctgaacttagtctaagtgcagataacagctttgaggaaaaaatccttaccttagtgatttgtctatgaatattcaatgtaggcaactatttaatatggtgtatatgttttcatttttaatctttcttcacttaaatatgaagttataactgtttcaatctccaacctcagcaatccataaagattgtcctaacattctggatatttgccactcatcagaaacaagttagattgatctgccacctcctcttctctcttttcttctccctgcctttcatcttcctggtttctctttgagggctatgcttctgtaagacaaagggaaaaaaagaagtgcagagttgtacagtaatacttggcaattacccgttaatctgggtaattccaatgaagtactgtcacagttactgttccatggaaatgagcatttgcagttattgcttttgcctccagtcttatagaatgcactctgcattgtgcgtatccagtagggttttcagcaaagacatggtcactacatgcactgtatgttcttgccaaacctcagcttctccatatgcaattgtgtgtctggtcagagtaagggaaaatgaatgcatcccttagcttgcattcattggtcagaatcttaactatcttaagagatggtgcagctctagattcaatagctctcctcagaagtggccctggcaaaactgaagataggacatccactgctctttagcttctagtgctgactggaatggtgaacatttaaagccagtgtttttcctcttggagccaccttagcactgagtcttgtaaaccttggccagcccttcctcaggccgtgccttctatcttgtgtgaatgatgcatcctttcttaagcgtcttctgctgacctcgtgcagcaccgcaggaagctgggatgctttcgagcttactttttctttatttgagcttctggtcatgtttcaaagccatcaaaatctaagcaagggagttacagggagggttagagaattaccaaaggacacaaaatgtcttgggttgtggaatagcacacatcagagaaatctcaaacatctcttaggaaaatctctaaatgtgtatatccccaagtatcttagccttccacctaccacataaagtgagggtatgtgtccctcaaatgagaaaaatgaaaacacactttcttaccacttcaaatctgggaggtggttggctcatttgttttgaagatactcgacactttgccctagcaaaatattgacttctttgatttttccttcagaaaaataagccctgttattcctatagacctaaataagggaggcagccagtttcaagaggctggctctaacaaaatataccaaggctgtcatctgtctcacttaatgaatgggaaactcctgattgagaagaatttgtcttcattaaaactagctaaaatgtacattgcaaatctgaagaaaacaatcatgactctgctaatttgagaagcaaaaaccaaaatttctcttttcaatctttgcaaattaaaaaggaatcttgccaagaataaacaaatcttcatttcatacctaattttaaaacgaattgtgtccccaaatatggtctattctggctaatcattttttaagcaaatcctcacttactttttctgagtcactttagtatgtaactaggataaatttcatagttgatcagaatgcaaatgttctaacttgacatttttgcccaagatacgttctttccaggtatagctgaattaagtaggaaaaatataaataattgctcttttaaaactataacaacttgaatgcctgcggttttatttccatctaatttaaaagttatctgtaacctttgtttgatagaaggtctgttgaagtgtctaagaaccatgttgaaatatttgtgataaataggccacaacttaaggatattatgcccaaaagtgaactgacagaggaaagtactcttcatataactgcacagtgaacaatttagaaagggaacagatgaccagacacagtggctcatgcctgtaatcccaaagctttgggaagttgagatgaaagaatcacttgaggccaggagttcaagaccagcttgggcaaaatagtgagaccgtatctctacaaaaacaaacaaataaacaaaaaatacctaaaaaaaaatttaaattagccaagcatggtggcatgtacctatgaccccagccacttgagggactgagggaagggaagattacttgagcccaggaattagaggctgcagtgagtgcactactgcactccagcctaggcaatacagcaaaagcctgtctctaaaaagagagagagataagtagatatgttttaattattagaagaaggtatttatcaataaagaattctcaaaaaaatggaattatcaaaaaattcaaaagttatgggtagcatctctttttcatctgaaaaagcttagtttcttattgaagactaaaaagaaaaatgccacttcttgaaggtggatacagcttcttaaatattggtatttgtagaaaaatttggtggcaggcaaaacttgaatcatctttcttgaacttgcattcaaataaagggtaaaaatcatgttaaatgctaaacatttttaaaaactgaaatatttaaagaatccaaaatatgctttagcttaaacttgagagctaagttaagtaaaaagaagaaaagaatagaaggtagaaaggaagggagaggaaaatggagagaagatgaggaagagaaagagaaagaaagggaatggacaaggagacaggaaggaagaatccaaagttgaaagtcacctaattgggatttgaacagtcagtttttaactcagaattttgttcttgtttctttgattgactaaaaacattgaatcattttccatgtaaggcatgtttttcctttcctcttcagagttatttagaaacagttcaaagaaaccaataatctatccatttcttctcatagaatttgctttggcagacaacttagtctatattagttaggattaggtttacctacaagtaacagaaaaagaaaaatgacaatggattaaataacatagaggtctatttctctttttatttcgaaattctggagacagtcagcaaagagccggatgtgatttccctagagacaaggaccgagactcctctcattgcttcatcctctgtggccgccatttttaagaccataacatgactcaaaatggctgctgaagcttcagccattggttttgtattctggccttggaggtggagaaggaacaaaaggaatgtttctttcctttaaggatatgcctcagaaatacacacactacttctgtttacatctcattagccaaaacttggtccacccccaactttgcagtgaagaaacctgggtattatagtctttattcttaatgactttatgcttaactaaaaagtaagagctttgctggacatggtggcttatgcctgtaatttcagcaatttggaaggccaaggcgtgcagatcacttgagcttacgagttcgagaccagcctgagcaacatggcaaaaccccatacctacaaaaaatacaaaaaccagctgtggcggtgtgtgcctatagtcccagctacttgggaggttgaagtaggagggttgtttgaacctgggagacggaggttgcagttagccaagatcatgccactgcactccaacctgggagatggagccaaaccttgtctcaaaaaaaaagcggggggggcttcatttattagtaagaaggaaaaatatttataaaatcatacttagcagtttcaatcacacagttcaaactaattgacatgatttcttggaacagtgttttcatttgtagtactttataacacattctagaaaaaatgtacatatattcttcagtactgtgagagatttaatcatcaagtatgtgaaatgagaatttctgcctcatcttgtttccttatcttgtctttgtggttagaaagaaatgaaaataaatcagtagcactacatccttctaggtttcccataattttgcagacaggtttagcttttcttctctagaattgagtttaaaattctagagccaatctaacattttgcttggtcctcattgtgctgccacaataaattaattcttctatggtcataacacttggctattttattttggtagggccttctcttctgaattgattggtagtgttgttattttcttgttattcagtttaacaagtacataatcaacatcagtgcttgggaagtcaggagtacgagagataaataagaagtatatgatcttttctcttattttctctcagtataagttggacctgtttttcccttcatctctttttcttcaagaacataatatcggctgaagtggaatgagtattcaaattgtccaaaaaaatatacaagtgagggaattaataaaattttttgtaattataaatatgtatatattggggggcaaaatatgactttttatttttatttttaaccaccagattgagtatgttgatacatcaaatgccagtcttttatcttcctagtttttcaaatagaaaagtgatactaacatcaataattaaacttcccaagatttttttgtctctctctgaatcaagttcgtcgtctatttacgtgcttctcagttgacatttgtgaaggcagattatacacatgagacagtggtgaataaatccaccccaaaattcctttgcagatcttgagtatttgccaatattctctatgatttatttacattcttttttcatatatatactttaagttctgggatacatgtgcagaatgtgcaggtttgttacataggtatacatgtgccatggtggtttgctgcacccatcaattcatcatctacattaggtatatctcctaatgttatccctccccttgtcccccactccccaacaggccctggtgtgtgatgttcccctccctgtgcccatatgttctcattgttcaactcccacttaagagtaagaatatgcagtgtttgttttttgttcctgtgttagtttgctgagaatgatggtttccagcttcatccatgtccctgcaaaggacattaactcattttttatggctgcatagtattccatggtgtatatgtgccacattttctttatccgttctaacattgatgggcatttgggttggttccaagtctttgctattgtgaatagtgctgcaataaacataggagtgcatgtgtcattatagtagaatgatttataatcctttgggtatacacccagtaggggattgctggatcaaatggtatttctagttctagatccttgaggaattgccacactgtcatccacaatggttgaagtaaattacactcccaccaacagtgttaaaagcattcctatttctccacatcctctccagcctctgttgtatcctttttaatgatcgccattctaactggtgtgaggtggtatctcattgtcgttttgatttgcatttctctaatgaccagtgatgatgagatttttttttacgtttgttggctgcataaatgtcttcttttaagaagtgtctattcatatccttaacccactttttgatggagttgttttttttcttgtaaatttgtttaagttccttgtagattctggatattagccctttgtcagatggataggttgcaaaaattttctcccattctgtaggttgcctgttcactctgataatagtttcttttgctgcacagaagctccttagtttaattagatcccatttgtcaattttggcttttgttgacattgcttttggtgtttcagtcatgaagtctttgcccatgcctgtgtcctgaatggtattgcttaggttttcttctagggttttaatggctttgggttttacatttaagtttttaagccatcttgagttaatttttgtacaagatgtaaggaaggggtccagtttcagttttctgcgtatggctagctaattttcccagcaccatttattaaataggaaatcctttccccattgcttgtttttatcaggtttgtcaaagatcagatggttgtagatgtgtggtgttatttctgaggcctctgttctgttgcattggtctatatatctgttttagtaaaagtaccatgttgttttggttactgtagccttgtagtatagtttgaagttaggtagcatgatgcctccagctttgttctttttgcttaggattgttttggctatatgggctctttttggttccctatgaaatttaaagtagttttttctaattctgtgaagaaaatcaatgttagtttgatgggaatagcattgaatctataaattactttgggcagtatggccatttttacaatattgattcttcctatccatgagcatggaatgtttttccatttgtttgtgtcctctcttatttccttgagcagtggtttgtagttcttgaagaggtcattcacatcccttgtaagttgcattcctaggtattttattctctttgtagcaattgtgaatgggagtttgttcatgatttggctctctgtttgtctattattggtgtataggaatgcttgtgatttttgcacattgattttgtatcctgcaactttgctgaaattgcttatctctttaaggagttttggggttgagacaatggggttttctaaatgtacaaccatatcatctgcaaacagagataatttgactttctctcttcctattcgaatacgctttatttcattctcttgcctgtttgccctggccagaacttctaatactgtgttgaataggagtggtgagacaagccacccttgtcttgcgccagttttcaaagggagtgcttccagtttttgcccattcagtgtgatattggctgtgggtttgtcataacagctcttattattttgagatatgttccatcaatacctagtttattgagtgtttttagcatgaaggagggttgaattttgtcgaaggccttttccgcatctattgagataatcatgtggtttttgtcattggttctgtttatgtgatggattacattcattcatttgcatatgttgaaacagccttgcatcccagggatgaagctgacttgatcatggtgggtaagctttttaatgtactgctgcatttcttttgccagtgtttcattggggattttcacatagatgttcatcagggatattggcctgaaattttcattttttgttgtgtctctgcctgggattggtatcagaatgatgctggcctcaaaatatgagttagggaggagtctgtcttttctactgtttggaatagtttcagaaggaatggtaccagctcctctttgtaactctggtagagttcagctatgagtccatctggtcctgggcttttttttttagttggtcagctattaattactgcctcaatttcagaacttgttattggtctattcagggattcaacttcttcctgggttagtcatggtagggtgaatgtgtccaggaatttatccatttcttctaaattttttagtttatttggatagagttgtttgtaatattctctgacggtagtttgcatttctgtgggattagtggtgatctccactttatcactttttattgtgtctatttgattcttccctcttttcttctttattagcctggctagccatctaagtattttgttaatcttttcaaaaaaccatctcctgtattcattgattttttgaagggtttttcgtatctctttcagttctgttctgatcttagttatttcttgtcttctgctagcttttgaaatagtctgctcttgtttctttaattcttttaattgtgatgttagcgtgttgattgtagatgtttagattttagatgtttagatgtttcccactttctcctgtgagcacttaggtctataaatttccttctaagcactccctctaagctctatcccagagattctggtacattgtgtctttgttcttgttggtttcaaagaacttatttatttctgctgtgatctcattattttcccaggagtcattcagaagcaggttgttcagtttccatgtagttgtgtggttttgagtgagtttcttaatcctgagttctaacttgattgcactgtggtctgagagactgtttgttatggttttcattcttttgcatttgctgatgagtgttttacttccagttatgtggtcgattttaggaaaatgtgctatgtgatgctgaggagaatgtatattctgttgatttggggtggagagttctgtagatatctattaggtctgcttggtcaagaggtgagttcaagtcctgaatatccttgttaattttctatctcggtgatctgtctaatacacacaatggagtgttaaagtctcccactattattgtgtggtagtctaagtctctttgtaggtctctaagaacttgctttatgaatctgggtgctccactattaggtgcatacatatttaggatagttagctcttcctgttgcattgatccttttactattatgtaatggccttctgtgtctgttttgatttttgttggcttaaagtctgttttaccagaggctaagattgcaacccctgcttttttttgctttccatttgcctggtaaatatctctccatccttttattttgagcctatgtgtgtctttgcacatgagatgggtctcgaatacaacacaccaatgggttttgactctttatccaatttgccagtctgtgccttttaattggggcatttagcccatttacatttaaggttaatattgttatgtgtgaatttgattctgtcattatgatgatagctggttattttgcccattagttgatgcagcttcttcatagtgtcgatggtctttacattttggaatgtttttgcagtggctggtactggttgttcctttccatatttagtacttctttcagaagctcttgtaaaggcaggcttggtgtgacaaaattcctcagcatttgcttgtctgtaaaggattttatttctccttcacttgtgaagctcagtttggctggatatgaaattctgggttgaaaattcttttctttaagaatgttgaatattagcccccaatctcttgtggcttttagggtttctgcagagagatctgctgttagtatgatgggcttccctttgtaggtaacccaacttttctctctggctgcccttaacattttttctttcagttcaaccttggtgaatctgacgattatgtgtcttggggttgctcttctcaaagagtatctttgtggtgttctctgtatttcctgaatttgtattctgtatttcctaagcctgccttgcgaggttggggaagttctcctggattatatcctaaattgtgctttccaacttgattccattctccccatcacttttaggtacaccaatcaaacgttggcttggtcttttcacatagtcccatatttctgagaggttctgttcattccttttccatttttttcttctaatcttgtcttcatgctttatttccttaagttgatcttcagtctctgatatcctttcttctgcttgatcgattcagctattgatacttgtgtatgcttcatgaagttctcgtgctgtgtttttcagctccatcaggtcatttgtgttcttctctaaactggttattctctaaactggttattctagttagcaattcctctaaccttttatcaaggttcttagcttcctcgtattgggttactatatgttccattcgctctgaggagttcgttattacccatcttctgaagcttacttctgtcaatttgtcaaacacattctccattcagtattgttcccttgctggtaaggagttgtgatcctttggaggagaagaggcgttctggttttgggaattttcagccttattggactggtttttcctcatctttgtggctttatctacctttggtctttggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtagctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacactgaagtacaagatgactactgtttttaatacattttctcactatattatatatttattgtagtaaacttagaaaccatatgcatcttgaatgttcctgaattcttcagattttggaggattacccccctatttcatgcacaaataaaagtcttaagctacatgactataggaaacctggtccctcccctagaaatttctgagcaaccctggagagcgtttaaatgttctgcaagtgtacccaggtgatgccactgcccactgcagacagctgctctgggcttccccaccaatgcccctgactccaattacatctcacccctgccactcactccaccctgcctcttcccaaaacaggaactcggcctctcttttgattccacaagcaaagttgaaacaaacctttgtaactaacaagtgttactaaggttttgtggtaaatatactccagaaaagaaaaccttaaagtaggtctcaggtaccaatgagtccagagacattctgaatccaccttcacaggctggtctccatcagactcttcttgctcccctgcctctatcttgttgctcccaaggagatctgcccacttttgacttcttcattgcctctgagacaggtcatcaaaacatcctccaccacaacccagccagggagtaaaatccccttaacatgagagtactgtagtctccacaaaaattatttaaaagaacactttattctttacattatttgacagaacatttaacatctgacctgagtcatttgcactgggattccatccccagatcagactttcccaaaaacagtgagtgaatttgtcttgaacaaattgctagcacctcacagtgcattcatcacagaaaaaaaaaaaaagggaggagcctgttaacttttatgggaactttctgtattgcttttgcaactttttgtagttctacaactttatttaaaaggaagcagggaggcttgttttagtgacatactccagattctactcttagagatgaaagcacaacaacataaaaattcatacttttttttccatttccatttatcaaagtagaaatatagtctagtctcagagtgtctatctacttacaagccaaattttaagaagaaaagtttacattgctgatatgactgccttttcccttggatgaggatttgaattcctatgcctcgttggacaaatggaaatcatattgtatggcagacacatttcatagcaacaacttaagcataccctaagaatgaccctatggtttaagaagaatgtgtatttggagatctgtgctaaagaatccaggagtggctaacccggagattcatctcttatctataaggaacatctgagcccctagtccatcctgtggaacgcagcccattcaggagattgaggccctttgttttgggttaaacgaatgttgccaagtggatgttgctagcagaacagtgataagtgaaaatgtcatataaactgcatgctttttacaagtggttgcagtcctcctctccagcccactatcactggactgccccatatgtaagttccctcaataaactctgtgtctcattcactggcttcaggtctcttattcagcctctcaaacatggtgccctccctaccaaagtgaatgacatcaagcacgacacatattagatgttcctataatctaatcatagctatgatttaaactacagactagtatatattatttttcttctctttcatcttttgcctgtgtcacaataacttaatcatgtctttgctcctcctctgcaatctcactgccattgcatttattatggtactctttattaaatagtctcttcatggagcttagaccctcccccatcccccaaaactctgcttttcagtattatatttctaaagtaagaaatctgagccgtgttttatcaccctgcttaaaatcttgaaataggataaagactcagatccaaatttctcatcttggtatataaactcatccattatctgacccaacataggttatcagccttgtctcttacacacaacgtgtttttttcttgctcttatctaaacattgcccctgctctttcatgcttatatgatttgggagctcttcatgtataatggttatatcatcttgaatgctagatatatttccacattgtttaagacctaagttcaattatgtcctactaaaagtgcactcaatatataattattggctgcgtgtggtagctcatgcctataatcccagcactttgggaggccgaggtggctgaatcgcttgagttcaggagtttaagattaacctggccaacatgacaagaccacgtatctactaaaaatacaaaaaaaaacatcaactgggtgtggtggctggcgtgtgcctgtaattctacttgagaggctgaggcatgagaatcacttgattcttggagaatcacagctgcttgggaggctgaggcatgagaacccttgaattcaggaggtggagtatattaggctgttttcacactgctaataaagacctacctgagactgggtaatttataaaaaataagaggtttaatggactcacagttccacatgactgaggaggcctcacaatcatgacagaaggcaaaggaggagcaaaggcacgtcttacatagcagcagggaagagatcatgtccaggggaactctcccttacaaaaccatcagatatcatgagactaatttactatcatgagcacagcatgtgacagacctcccccccatgattcaataacctcccactgggtccctcctataacacatgggaattatgacagctacaattcaagatgagatttgggtggggaacacagccaaaccatatcattctgccgctgcccctcccaaatctcatgtcctcacatttcaaaacacagtcatgccttcccaacagtcccccaaagtcttaactcattacagcattaacacaaaatcccaactccagagtctcatctgagacaaggcaaatcccctctgcctatgagactgtaaaaatcaaaagcaagttagttactttctagatacaaggggagtacaggcattgggtaaatactcctgttctaaattggagaaattggcaaaaaccaaagggctataggccctatgcaagtctggaatccaatggggcagtcattaaaccttaaatttccaaaatgatctcctttgactccatgtctcacgtccaggtcacagtgatgcaagaggtgggctcccacagccttgggcagctccacttctgtggctttgcagggtacaacctccttcccagctgctttcatgggctggttatgagtgtctatggcttttccagatgcacagtgcaatctgtcagtgggtctaccattctggggtctgaaggatggtgaccctcttcttgaagctccactaggcagtgcctcagtgggcaccttgtgtgagggctccaaccccacatttgccttctccactgccctagcagagggtctccatgagggctccgcacctgcagcacacttctgcctggatatccaggtgtttccatacatcctctgaaatctagatggagattcccaaacctcagttcttgacttctatgcacccacaagctcaacaccacatggaagctgccaaggcttggggcttgcaccctctgaagccacagcctgagctgtaccttgtccccttttagccaaggctggagctgctggtaggcagggcaccaagtcccttggatgtacacagcaggtgggctttgggcccagcccaggaaaccatttgttccttctaggcctctgggcctgtgatgggaggggcagctatgaagatctctgacatgccctggagacatcttcctcattgtcttagtgattagcatttcagctcctcattacttatgcaaatttctgcagacagcttcaatttcttcccagaaaatggggttttcttttctatcacatcatcaggctgcaaatcttccaaacttttaggctctgcttcctcctgaatgcgtcaccgcttaaaaatttcttcccccagatatgctaaatcatctctttcaagttcagtgttccacagatctctaggacaggggcaaaatgccaccagtctctttactggagtaaagaacaacctttattccagttcccaacaagttccttatctccatctgagaccacctcagcctggactttatcatccatagcactatgagcattttggtcaaagacattcaacaaatttctaggaagttccaaactttctcacatcttcctttcttcttctgagccttccaaactgttccacctgttacccagttccaacatcacttccacattttcgggtacctttacagaggtgcaccaccatctggtaccaatttactgttttagtctgttctcactctactaataaagacatacctgagagtgggtaatttataaaaaataccaggtttaatgtactcacagttccatatggctggggagacatcataatcatggcagaaggcaaaggaggagcaaagtcatgtcttacatggtggcaaggaagagagcttgtgtagggtaactcccccttacaaagccatcagatctcatgagacttattcactatcacaagatcagcacatgaaagacccacccccatgattctataactcccacaacatgtgggaattatgggagctacaatctaagatgagatttgggtggggacacagccaagccaaatcacagagcttgcgatgagctgagatcatgccactgcactccaacagagggagactctgtctcgaaaaaacattttttaataaaaagaaaaatatgtatatatataattattgaacatttactctgtggaagatgttggttctacttggcagaattggtctttctacaccctaagaaatttagtattacttccattattagacattgaaccctaaatacacctatgacatcatgaattctctgagtgctttgtaaataggaatctaattagcttttttggcaatcacattaccttgttcattcccatcaaacctttctaacctggagccataaggttatcattccctgccctgcacacaaaggtaagtgttaagtaaaaattcctcatcttgtatctgctcaatgaatgtttagacttgatttcaggcacttatattgacttttattacacttaattttgtttgattcagcaaatcatttcaatctaataagatcaatttaaatgttgatattttaaaaatcaacttattttttattctcagattcatgtgatctgcaagtatgcaaacatctttttatccagatgctgcaaattattgaataagcaagaattagtaagatattatcaccaaattgtcacatcagtcaagcctcatgtgcttcctaagaactgaggtgatgcattattttagagtgtcattctaaaccccagattcaacatcttcctaatctttctagtgcagtctaatatataaattttatgaaaagcataggtttttttttaaccagcagtgctctttgagaatttacattgattcctaaagattgccattgctttgtataaaatgttataaattatcttagcatcttacctggaatttccactaaattcaccaatttatgatttgtgaaatctgattttactttttgaaaattttcatgtgaatttcccattttcagtgttgtagcacctctctcttcctctaagatcctgcaagctcatcaaaagccatgatcttattataccagcagttttatttattcaatctttcaacaagtagttattgaacttctataatgtgccaggctctggagctcgccttacaccaaacagacacaatcgatccattcgaagtgtcgtaattacacattgagggaccaactagaccttttctcattgtaaacttggagcaaaagtaaattcattaaaataaatttacattatagtgccacaaaaaaatgaacagaaccagaaagcattttttacaaaaattaacagaacagtgtgatagaggggaaaaggatgtgagatcatggtgccctaccttcaatagggtggccagaaaacacctctctgaagaagcagcatttgagctgagacctgaagaacgaggagtcagtgatgcagagaacctcaggagatgccttccaatctgagaaaaga
